United States Patent
Guttman et al.

(10) Patent No.: US 10,669,564 B2
(45) Date of Patent: *Jun. 2, 2020

(54) COMPOSITIONS AND METHODS FOR MEASURING BLOOD GLUCOSE LEVELS

(71) Applicant: Smartzyme Biopharma Ltd., Ness-Ziona (IL)

(72) Inventors: Chen Haim Guttman, Petah Tiqva (IL); David Baram, Nir-zvi (IL); Itamar Oz Gofberg, Rehovot (IL); Dotan Omer, Raanana (IL)

(73) Assignee: Smartzyme Biopharma Ltd., Ness-Zion (IL)

( * ) Notice: Subject to any disclaimer, the term of this patent is extended or adjusted under 35 U.S.C. 154(b) by 0 days.

This patent is subject to a terminal disclaimer.

(21) Appl. No.: 15/746,609

(22) PCT Filed: Jul. 22, 2016

(86) PCT No.: PCT/IB2016/001150
§ 371 (c)(1),
(2) Date: Jan. 22, 2018

(87) PCT Pub. No.: WO2017/013495
PCT Pub. Date: Jan. 26, 2017

(65) Prior Publication Data
US 2019/0002949 A1    Jan. 3, 2019

Related U.S. Application Data

(60) Provisional application No. 62/195,914, filed on Jul. 23, 2015, provisional application No. 62/195,900, filed on Jul. 23, 2015, provisional application No. 62/345,386, filed on Jun. 3, 2016.

(51) Int. Cl.
| C12Q 1/00 | (2006.01) |
| C12Q 1/32 | (2006.01) |
| C12N 9/04 | (2006.01) |
| A61B 5/145 | (2006.01) |
| A61B 5/1486 | (2006.01) |
| C12N 9/06 | (2006.01) |

(52) U.S. Cl.
CPC .......... C12Q 1/006 (2013.01); A61B 5/14532 (2013.01); A61B 5/14865 (2013.01); C12N 9/0006 (2013.01); C12N 9/0016 (2013.01); C12Q 1/32 (2013.01); C12Y 101/05 (2013.01); C12Y 104/01002 (2013.01)

(58) Field of Classification Search
None
See application file for complete search history.

(56) References Cited

U.S. PATENT DOCUMENTS

| 2004/0023330 A1 | 2/2004 | Sode |
| 2008/0206833 A1 | 8/2008 | Yamaoka |
| 2011/0076707 A1 | 3/2011 | Yamaoka |
| 2012/0107903 A1 | 5/2012 | Sode et al. |
| 2018/0282705 A1 | 10/2018 | Guttman et al. |

FOREIGN PATENT DOCUMENTS

| EP | 3 162 893 A1 | 5/2017 |
| WO | 2016087937 A2 | 6/2016 |

OTHER PUBLICATIONS

Yang et al. Expression, characterization and mutagenesis of an FAD-dependent glucose dehydrogenase from Aspergillus terreus., Enzyme and Microbial Technology, 68: 43-49, 2015, EPub Oct. 23, 2014.*
Whisstock et al. Quaterly Reviews of Biophysics, 2003, "Prediction of protein function from protein sequence and structure", 36(3): 307-340.*
Witkowski et al. Conversion of a beta-ketoacyl synthase to a malonyl decarboxylase by replacement of the active-site cysteine with glutamine, Biochemistry. Sep. 7, 1999;38(36):11643-50.*
Krasney et al. Evolution of the glucose dehydrogenase gene in Drosophila. Mol. Biol. Evol. 7, 155-177, 1990.*
Yamashita et al., "Direct electron transfer type disposable sensor strip for glucose sensing employing an engineered FAD glucose dehydrogenase". Enzyme Microb Technol, Feb. 5, 2013, vol. 52, No. 2, pp. 123-128. Especially abstract, p. 125 fig 2, p. 126 fig 3.

(Continued)

Primary Examiner — Iqbal H Chowdhury
(74) Attorney, Agent, or Firm — Greenberg Traurig, LLP

(57) ABSTRACT

In some embodiments, the present invention a mutated FAD-GDHα protein, wherein the mutated FAD-GDHα protein is mutated from a wild-type first species to contain at least one point mutation, wherein the mutated FAD-GDHα protein comprises: $P(X)_{n=8}X^4(X)_{n=1}6V(X)_{n=6}RN(X)_{n=3}YDXRPXCXGX^3NNCMP(X)_{n=1}CP(X)_{n=2}A(X)_{n=1}Y(X)_{n=1}G(X)_{n=6}A(X)_{n=2}AG(X)_{n=6}AVV(X)_{n=3}E(X)_{n=8-9}A(X)_{n=2}Y(X)_{n=1}D(X)_{n=5}HRV(X)_{n=5}V(X)_{n=2}A(X)_{n=3}E(X)_{n=2}K(X)_{n=4}S(X)_{n=5}P(X)_{n=1}G(X)_{n=2}N(X)_{n=4}GRN(X)_{n=1}MDH(X)_{n=4}V(X)_{n=1}F(X)_{n=6-7}W(X)_{n=1}GRGP(X)_{n=9}RDGXX^5R(X)_{n=19}T(X)_{n=14}L(X)_{n=14}X^2(X)_{n=1}X^1(X)_{n=1}E(X)_{n=4}P(X)_{n=1}NR(X)_{n=3}S(X)_{n=4}D(X)_{n=2}G(X)_{n=7}Y(X)_{n=4}Y(X)_{n=32-35}$, wherein each X represents a wild-type amino acid residue of the first species and n indicates the number of the wild-type amino acid residues of the first species represented by a respective parenthetical at that position, wherein: a) $X^1$ is selected from the group consisting of X, S, C, T, M, V, Y, N, P, L, G, Q, A, I, D, W, H, and E, wherein if $X^1$ is L, H or V, then $X^2$ is D; b) $X^3$ is selected from the group consisting of G, H, D, Y, S, and X; c) $X^4$ is selected from the group consisting of S and X; and d) $X^5$ is selected from the group consisting of L and X.

16 Claims, 56 Drawing Sheets
Specification includes a Sequence Listing.

(56) References Cited

OTHER PUBLICATIONS

International Search Report and Written Opinion in International Application No. PCT/IB2016/001150 dated Aug. 24, 2017.
Ferri, et al., "Review of Glucose Oxidases and Clucose Dehydrogenases: A Bird's Eye View of Glucose Sensing Enzymes", Journal of Diabetes Science and Technology, vol. 5, Issue 5, Sep. 2011.
Wang, Joseph, "Electrochemical Glucose Biosensors", Chem. Rev., vol. 108, pp. 814-825, (2008).
"Gluconobacter japonicus fdhS, fdhC, fdhL genes for small subunit of fructose dehydrogenase, cytochrome subunit of fructose dehydrogenase, large subunit of fructose dehydrogenase, complete cds, strain: NBRC 3260"; Nucleotide, GenBank: AB728656.1; Mar. 1, 2013.
Kawai et al., "Heterologous Overexpression and Characterization of a Flavoprotein-Cytochrome c Complex Fructose Dehydrogenase of Gluconobacter japonicus NBRC3260", Applied and Environmental Microbiology, Mar. 2013, vol. 79, No. 5, pp. 1654-1660.
Marx et al., "Electrospun gold nanofiber electrodes for biosensors", Biosensors and Bioelectronics 26 (2011), pp. 2981-2986.
Pfutzner et al., "Development of a new glucose dehydrogenase mutant with direct electron transfer and enhanced stability and specificity", Diabetes Technology and Therapeutics vol. 18, Suppl. 1, p. A-78, Abstract No. 194. 2016 (Year: 2016).

\* cited by examiner

| Substitutions | Linear fit ($R^2$) |
|---|---|
| F406S | 0.9977 |
| F406C | 0.994 |
| F406T | 0.9972 |
| F406V | 0.9657 |
| F406Y | 0.9925 |
| F406N | 0.9714 |
| F406P | 0.9983 |
| F406L | 0.9324 |
| F406G | 0.9833 |
| F406A | 0.9961 |
| F406I | 0.9643 |
| F406D | 0.9851 |
| F406E | 0.9935 |
| N215G | 0.9986 |
| N215H | 0.9967 |
| N215T | 0.9945 |
| N215D | 0.9970 |
| N215Y | 0.8993 |
| N215S | 0.9817 |
| W.T | 0.2773 |

FIGURE 32

|  | | Glucose | | | Xylose | | |
|---|---|---|---|---|---|---|---|
| Substitutions | S.A. [umol/min/mg] | Kcat [1/min] | km [mM] | kcat/km | Kcat [1/min]2 | km [mM]2 | kcat/km2 |
| F406S | 22.67 | 895.8656 | 256.439 | 3.49 | ND | ND | ND |
| F406C | 9.10 | 354.65 | 14.80 | 23.97 | 67.86 | 2096.37 | 0.03 |
| F406T | 8.98 | 350.8039 | 23.79141 | 14.74 | ND | ND | ND |
| F406M | 8.91 | 347.5169 | 1.250741 | 277.85 | 119.4209 | 209.1402 | 0.57 |
| F406V | 7.96 | 310.2943 | 5.466694 | 56.76 | 112.3689 | 1215.387 | 0.09 |
| F406Y | 5.53 | 215.8009 | 23.47327 | 9.19 | ND | ND | ND |
| F406N | 3.66 | 142.7834 | 3.442402 | 41.48 | 46.52752 | 696.6943 | 0.07 |
| F406P | 4.26 | 130.6831 | 4.121073 | 31.71 | 37.39547 | 461.812 | 0.08 |
| F406L |  | 130.4688 | 2.37416 | 50.74 | 150.2704 | 826.2048 | 0.18 |
| F406G | 2.89 | 112.6067 | 3.331009 | 33.81 | 48.15955 | 663.8568 | 0.07 |
| F406Q | 2.85 | 110.8854 | 1.430994 | 77.49 | 58.85793 | 305.0829 | 0.19 |
| F406A | 2.81 | 109.70 | 14.75 | 7.44 | ND | ND | ND |
| F406I | 2.61 | 101.7985 | 3.654968 | 27.86 | 176.0174 | 2948.5 | 0.06 |
| F406D | 2.52 | 82.98 | 4.23 | 19.61 | 59.18 | 423.78 | 0.14 |
| F406W | 2.00 | 77.30366 | 0.745194 | 104.41 | 63.62476 | 18.51327 | 3.44 |
| F406H | 1.89 | 73.42311 | 0.526541 | 139.44 | 38.81924 | 116.1307 | 0.33 |
| F406E | 1.84 | 71.87 | 12.29 | 5.85 | 39.55 | 958.67 | 0.04 |

ND – Not detectable

FIGURE 33

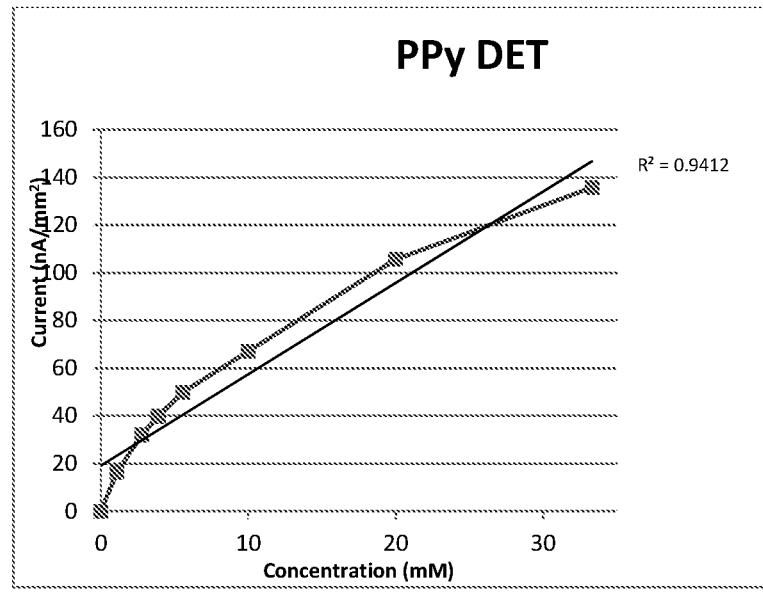
FIGURE 35A
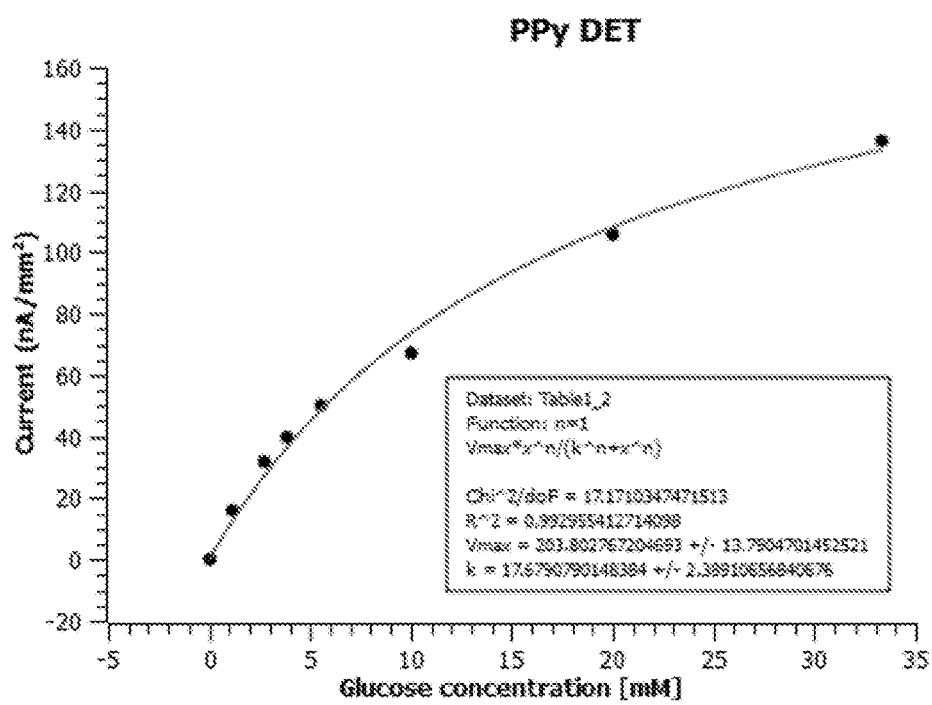
FUGURE 35B

|  | MET | | DET | |
|---|---|---|---|---|
|  | Current | Linearity | Current | Linearity |
| Mutation | I13 (nA/mm2) | $R^2$ | I13 (nA/mm2) | $R^2$ |
| 406L | 85 | 0.909 | 4 | 0.76 |
| 406G | 155 | 0.983 | NA | NA |
| 406Y | 24 | 0.992 | NA | NA |
| 215S | 503 | 0.471 | NA | NA |
| 215T | 735 | 0.318 | NA | NA |
| 177 | 466 | 0.32 | 81 | 0.49 |
| 353 | 384 | 0.34 | 98 | 0.53 |
| 177,406 | 118 | 0.951 | NA | NA |
| 353,406 | 95 | 0.953 | 8 | 1 |
| 215,406 | 131 | 0.964 | 10 | 0.98 |
| 406,177,353 | 54 | 0.944 | 2 | 0.99 |
| 406,177,215 | 220 | 0.96 | 21 | 0.98 |
| 406,353,215 | 268 | 0.94 | 32 | 0.89 |
| 353,177,215,406 | 208 | 0.9517 | 15 | 0.96 |

The figures gray highlight in the table exeeds the following threshold in each parameter:

| | DET | | MET | |
|---|---|---|---|---|
| | I13 | >200 | I13 | >=15 |
| | Linearity | >0.89 | Linearity | >0.89 |

COMPOSITIONS AND METHODS FOR MEASURING BLOOD GLUCOSE LEVELS

CROSS-REFERENCE TO RELATED APPLICATIONS

This application is a U.S. national phase application under 35 U.S.C. 371 of PCT International Application No. PCT/IB2016/001150, entitled "Compositions and Methods for Measuring Blood Glucose Levels", filed on Jul. 22, 2016 which claims priority to U.S. Provisional Patent Application Serial Nos. 62/195,900, entitled "Glucose Dehydrogenase and Methods of Use Thereof, filed on Jul. 23, 2015; 62/195,914, entitled "Glucose Dehydrogenase and Methods of Use Thereof, filed on Jul. 23, 2015; and 62/345,386, entitled "Compositions and Methods for Measuring Blood Glucose Levels", filed on Jun. 3, 2016, the contents of which are hereby incorporated by reference in their entirety.

TECHNICAL FIELD

In some embodiments, the instant invention is related to compositions and methods for measuring blood glucose levels.

BACKGROUND

Blood glucose monitoring is a way of testing the concentration of glucose in the blood (glycemia). Particularly important in the care of diabetes mellitus, a blood glucose test is performed by piercing the skin (typically, on the finger) to draw blood, then applying the blood to a chemically active disposable 'test-strip'. The test is usually referred to as capillary blood glucose. Current teaching counsels diabetic patients to measure their blood glucose level from two to seven times a day depending on the nature and severity of their individual cases. Based on the observed pattern in the measured glucose levels, the patient and physician together make adjustments in diet, exercise and insulin intake to better manage the disease. This information should be available to the patient immediately.

A biosensor is a sensor which utilizes the molecule identifying abilities of biological materials such as microorganisms, enzymes, and antibodies to apply the biological materials as molecule recognition elements. To be specific, the biosensor utilizes a reaction which occurs when an immobilized biological material recognizes a target specific component, such as oxygen consumption by respiration of a micro-organism, an enzyme reaction, or luminescence. Among biosensors, enzyme sensors have been advanced in practical applications, and for example, enzyme sensors for glucose reduces an electron acceptor by an electron generated by a reaction between an enzyme and a substrate included in a sample solution as a specimen, and a measurement device electrochemically measures the oxidation-reduction quantity of the electron acceptor, thereby to perform quantitative analysis of the specimen. The first electrochemical glucose biosensor relied on a thin layer of glucose oxidase ($GO_X$) entrapped over an oxygen electrode via a semipermeable dialysis membrane. Measurements were made based on the monitoring of the oxygen consumed by the enzyme-catalyzed reaction (Wang 2008). Second and third generation biosensors also rely on the effects of enzyme-catalyzed reactions to determine glucose levels (Ferri et al. 2011).

SUMMARY OF INVENTION

In one embodiment, the present invention is a mutated FAD-GDHα protein, wherein the mutated FAD-GDHα protein is mutated from a wild-type first species to contain at least one point mutation, wherein the mutated FAD-GDHα protein comprises: $P(X)_{n=8}X^4(X)_{n=16}V(X)_{n=6}$ $RN(X)_{n=3}YDXRPXCXGX^3NNCMP(X)_{n=1}CP(X)_{n=2}$ $A(X)_{n=1}Y(X)_{n=1}G(X)_{n=6}A(X)_{n=2}AG(X)_{n=6}AVV(X)_{n=3}$ $E(X)_{n=8\text{-}9}A(X)_{n=2}Y(X)_{n=1}D(X)_{n=5}HRV(X)_{n=5}V(X)_{n=2}$ $A(X)_{n=3}E(X)_{n=2}K(X)_{n=4}S(X)_{n=5}P(X)_{n=1}G(X)_{n=2}N(X)_{n=4}$ $GRN(X)_{n=1}MDH(X)_{n=4}V(X)_{n=1}F(X)_{n=6\text{-}7}W(X)_{n=1}GRGP$ $(X)_{n=9}RDGXX^5R(X)_{n=19}T(X)_{n=14}L(X)_{n=14}X^2(X)_{n=1}X^1$ $(X)_{n=1}E(X)_{n=4}P(X)_{n=1}NR(X)_{n=3}S(X)_{n=4}D(X)_{n=2}G(X)_{n=7}Y$ $(X)_{n=4}Y(X)_{n=32\text{-}35}$, wherein each X represents a wild-type amino acid residue of the first species and n indicates the number of the wild-type amino acid residues of the first species represented by a respective parenthetical at that position, wherein:

a) $X^1$ is selected from the group consisting of X, S, C, T, M, V, Y, N, P, L, G, Q, A, I, D, W, H, and E, wherein if $X^1$ is L, H or V, then $X^2$ is D;
b) $X^3$ is selected from the group consisting of G, H, D, Y, S, and X;
c) $X^4$ is selected from the group consisting of S and X; and
d) $X^5$ is selected from the group consisting of L and X.

In one embodiment,
a) $X^1$ is selected from the group consisting of S, C, T, M, V, Y, N, P, L, G, Q, A, I, D, W, H, and E, wherein if $X^1$ is L, H or V, then $X^2$ is D;
b) $X^3$ is selected from the group consisting of G, H, D, Y, S, and X;
c) $X^4$ is selected from the group consisting of S and X; and
d) $X^5$ is selected from the group consisting of L and X.

In one embodiment,
a) $X^1$ is selected from the group consisting of S, C, T, M, V, Y, N, P, L, G, Q, A, I, D, W, H, and E, wherein if $X^1$ is L, H or V, then $X^2$ is D;
b) $X^3$ is selected from the group consisting of G, H, D, Y, S, and X;
c) $X^4$ is X; and
d) $X^5$ is X.

In one embodiment,
a) $X^1$ is selected from the group consisting of S, C, T, M, V, Y, N, P, L, G, Q, A, I, D, W, H, and E, wherein if $X^1$ is L, H or V, then $X^2$ is D;
b) $X^3$ is X;
c) $X^4$ is X; and
d) $X^5$ is X.

In one embodiment,
a) $X^1$ is X;
b) $X^3$ is selected from the group consisting of G, H, D, Y, S, and X;
c) $X^4$ is X; and
d) $X^5$ is X.

In one embodiment,
a) $X^1$ is selected from the group consisting of S, C, T, M, V, Y, N, P, L, G, Q, A, I, D, W, H, and E, wherein if $X^1$ is L, H or V, then $X^2$ is D;
b) $X^3$ is selected from the group consisting of G, H, D, Y, and S;
c) $X^4$ is S; and
d) $X^5$ is X.

In one embodiment,
a) $X^1$ is selected from the group consisting of S, C, T, M, V, Y, N, P, L, G, Q, A, I, D, W, H, and E, wherein if $X^1$ is L, H or V, then $X^2$ is D;
b) $X^3$ is selected from the group consisting of G, H, D, Y, and S;
c) $X^4$ is X; and
d) $X^5$ is L.

In one embodiment,
a) $X^1$ is selected from the group consisting of S, C, T, M, V, Y, N, P, L, G, Q, A, I, D, W, H, or E, wherein if $X^1$ is L, H or V, then $X^2$ is D;
b) $X^3$ is X;
c) $X^4$ is S; and
d) $X^5$ is L.

In one embodiment,
a) $X^1$ is selected from the group consisting of S, C, T, M, V, Y, N, P, L, G, Q, A, I, D, W, H, or E, wherein if $X^1$ is L, H or V, then $X^2$ is D;
b) $X^3$ is selected from the group consisting of G, H, D, Y, and S;
c) $X^4$ is S; and
d) $X^5$ is L.

In one embodiment, the amino acid sequence of the mutated FAD-GDHα protein comprises the amino acid sequence set forth in any one of SEQ ID NOS: 9-29, SEQ ID NOS: 46-104, or SEQ ID NOS: 105-129.

In one embodiment, a biochemical activity is increased at least 10% compared to a non-mutated FAD-GDHα protein from the wild type first species.

In one embodiment, a selectivity for glucose is increased at least 10% compared to a non-mutated FAD-GDHα protein from the wild type first species.

In one embodiment, a linearity of current as a function of glucose concentration is increased at least 10% compared to a non-mutated FAD-GDHα protein from the wild type first species.

In one embodiment, the present invention provides an enzyme electrode, configured to measure the amount of glucose in a physiological fluid, comprising the mutated FAD-GDHα protein according to some embodiments of the present invention immobilized onto the electrode, wherein the mutated FAD-GDHα protein according to some embodiments of the present invention is configured to catalyze glucose in the physiological fluid and produce electrons that are transferred to the electrode thereby generating an electrical current, wherein the intensity of the electrical current is indicative of the level of glucose in the physiological fluid.

In one embodiment, the enzyme electrode is a screen printed electrode.

In one embodiment, the enzyme electrode is configured to perform a single measurement.

In one embodiment, the enzyme electrode is incorporated into a glucose test strip.

In one embodiment, the mutated FAD-GDHα protein is immobilized on the electrode in a conductive matrix.

In one embodiment, the conductive matrix is selected from a group consisting of carbon paste, graphite paste, graphene oxide, or any other conductive matrix paste appropriate for use in screen printed electrodes.

In one embodiment, the conductive matrix is a conductive polymer.

In one embodiment, the conductive polymer is selected from the group consisting of: PEDOT, and Polypyrrol.

In one embodiment, the conductive polymer is electro-polymerized on the electrode together with the mutated FAD-GDHα protein.

In one embodiment, the conductive polymer is chemically polymerized on the electrode together with the mutated FAD-GDHα protein.

In one embodiment, the mutated FAD-GDHα protein of the present invention is immobilized to the electrode by chemical wiring.

In one embodiment, the conductive matrix further comprises an electron mediator.

In one embodiment, the enzyme electrode, configured to measure the amount of glucose in a physiological fluid, comprising the mutated FAD-GDHα protein according to some embodiments of the present invention immobilized onto the electrode further comprises at least one subunit selected from the group consisting of: wild-type FAD-GDHβ subunit, and a wild-type FAD-GDHγ subunit.

In one embodiment, the enzyme electrode of the present invention is incorporated into a biosensor configured for subcutaneous continuous glucose measurement, wherein the biosensor is configured to continually measure the amount of glucose in the subject.

In one embodiment, the biosensor is configured to continuously measure for up to two weeks.

In one embodiment, the biosensor comprises the mutated FAD-GDHα protein according to some embodiments of the present invention immobilized onto at least one enzyme electrode, wherein the mutated FAD-GDHα protein according to some embodiments of the present invention is configured to catalyze glucose in the subject and generate electrons that are transferred to the electrode and generate electrical current, wherein the intensity of the electrical current is indicative of the level of glucose in the subject.

In one embodiment, the electrode is made from a material selected from the group consisting of: carbon fiber, graphite, glassy carbon, gold, silver, copper, platinum, palladium, and metal oxide.

In one embodiment, the metal oxide is indium tin oxide.

BRIEF DESCRIPTION OF DRAWINGS

The present invention will be further explained with reference to the attached drawings, wherein like structures are referred to by like numerals throughout the several views. The drawings shown are not necessarily to scale, with emphasis instead generally being placed upon illustrating the principles of the present invention. Further, some features may be exaggerated to show details of particular components.

FIG. 1B shows the biochemical response of FAD-GDHα F406L to varying concentrations of glucose (rhombus), and xylose (rectangle). FIG. 1B shows the biochemical response of F406L to glucose and the non-linear fit through which $K_m$ (k) and $V_{max}$ have been obtained.

FIG. 3A shows the biochemical response of FAD-GDHα F406A to varying concentrations of glucose (rhombus), and xylose (rectangle). FIG. 3B shows the biochemical response of F406A to glucose and the non-linear fit through which $K_m$ (k) and $V_{max}$ have been obtained. F406A enzyme activity was determined via monitoring decrease of Dichlorophenolindophenol (DCIP) signal at $OD_{600}$. FIG. 3C shows electrochemical data representing the current response of the biosensor to various glucose concentrations (shown as a rhombus) and the linear fit across the data range is represented by the $R^2$ value.

FIG. 4A shows the biochemical response of FAD-GDHα F406C to varying concentrations of glucose (rhombus), and xylose (rectangle). FIG. 4B shows the iochemical response of F406C to glucose and the non-linear fit through which $K_m$ (k) and $V_{max}$ have been obtained. F406C enzyme activity was determined via monitoring decrease of Dichlorophenolindophenol (DCIP) signal at $OD_{600}$. FIG. 4C shows the electrochemical data representing the current response of the biosensor to various glucose concentrations (shown as a rhombus) and the linear fit across the data range is represented by the $R^2$ value.

FIG. 5A shows the biochemical response of FAD-GDHα F406E to varying concentrations of glucose (rhombus), and xylose (rectangle). FIG. 5B shows the biochemical response of F406E to glucose and the non-linear fit through which $K_m$ (k) and $V_{max}$ have been obtained. F406E enzyme activity was determined via monitoring decrease of Dichlorophenolindophenol (DCIP) signal at $OD_{600}$. FIG. 5C shows electrochemical data representing the current response of the biosensor to various glucose concentrations (shown as a rhombus) and the linear fit across the data range is represented by the $R^2$ value.

FIG. 6A shows the biochemical response of FAD-GDHα F406D to varying concentrations of glucose (rhombus), and xylose (rectangle). FIG. 6B shows the biochemical response of F406D to glucose and the non-linear fit through which $K_m$ (k) and $V_{max}$ have been obtained. F406D enzyme activity was determined via monitoring decrease of Dichlorophenolindophenol (DCIP) signal at $OD_{600}$. FIG. 6C shows the electrochemical data representing the current response of the biosensor to various glucose concentrations (shown as a rhombus) and the linear fit across the data range is represented by the $R^2$ value.

FIG. 7A shows the biochemical response of FAD-GDHα F406G to varying concentrations of glucose (rhombus), and xylose (rectangle). FIG. 7B shows the biochemical response of F406G to glucose and the non-linear fit through which $K_m$ (k) and $V_{max}$ have been obtained. F406G enzyme activity was determined via monitoring decrease of Dichlorophenolindophenol (DCIP) signal at $OD_{600}$. FIG. 7C shows electrochemical data representing the current response of the biosensor to various glucose concentrations (shown as a rhombus) and the linear fit across the data range is represented by the $R^2$ value.

FIG. 8A shows the biochemical response of FAD-GDHα F406H to varying concentrations of glucose (rhombus), and xylose (rectangle). FIG. 8B shows the biochemical response of F406H to glucose and the non-linear fit through which $K_m$ (k) and $V_{max}$ have been obtained.

FIG. 9A shows the biochemical response of FAD-GDHα F406I to varying concentrations of glucose (rhombus), and xylose (rectangle). FIG. 9B shows the biochemical response of F406I to glucose and the non-linear fit through which $K_m$ (k) and $V_{max}$ have been obtained. F406I enzyme activity was determined via monitoring decrease of Dichlorophenolindophenol (DCIP) signal at $OD_{600}$. FIG. 9C shows electrochemical data representing the current response of the biosensor to various glucose concentrations (shown as a rhombus) and the linear fit across the data range is represented by the $R^2$ value.

FIG. 10A shows the biochemical response of FAD-GDHα F406M to varying concentrations of glucose (rhombus), and xylose (rectangle). FIG. 10B shows the biochemical response of F406M to glucose and the non-linear fit through which $K_m$ (k) and $V_{max}$ have been obtained. F406M enzyme activity was determined via monitoring decrease of Dichlorophenolindophenol (DCIP) signal at $OD_{600}$.

FIG. 11A shows the biochemical response of FAD-GDHα F406N to varying concentrations of glucose (rhombus), and xylose (rectangle). FIG. 11B shows the biochemical response of F406N to glucose and the non-linear fit through which $K_m$ (k) and $V_{max}$ have been obtained. F406N enzyme activity was determined via monitoring decrease of Dichlorophenolindophenol (DCIP) signal at $OD_{600}$. FIG. 11C shows electrochemical data representing the current response of the biosensor to various glucose concentrations (shown as a rhombus) and the linear fit across the data range is represented by the $R^2$ value.

FIG. 12A shows the biochemical response of FAD-GDHα F406Q to varying concentrations of glucose (rhombus), and xylose (rectangle). FIG. 12B shows the biochemical response of F406Q to glucose and the non-linear fit through which $K_m$ (k) and $V_{max}$ have been obtained.

FIG. 13A shows biochemical response of FAD-GDHα F406S to varying concentrations of glucose (rhombus), and xylose (rectangle). FIG. 13B shows biochemical response of F406S to glucose and the non-linear fit through which $K_m$ (k) and $V_{max}$ have been obtained. F406S enzyme activity was determined via monitoring decrease of Dichlorophenolindophenol (DCIP) signal at $OD_{600}$. FIG. 13C shows electrochemical data representing the current response of the biosensor to various glucose concentrations (shown as a rhombus) and the linear fit across the data range is represented by the $R^2$ value.

FIG. 14A shows the biochemical response of FAD-GDH]α F406T to varying concentrations of glucose (rhombus), and xylose (rectangle). FIG. 14B shows biochemical response of F406T to glucose and the non-linear fit through which $K_m$ (k) and $V_{max}$ have been obtained. F406T enzyme activity was determined via monitoring decrease of Dichlorophenolindophenol (DCIP) signal at $OD_{600}$. FIG. 14C shows electrochemical data representing the current response of the biosensor to various glucose concentrations (shown as a rhombus) and the linear fit across the data range is represented by the $R^2$ value.

FIG. 15A shows a biochemical response of FAD-GDHα F406W to varying concentrations of glucose (rhombus), and xylose (rectangle). FIG. 15B shows a biochemical response of F406W to glucose and the non-linear fit through which $K_m$ (k) and $V_{max}$ have been obtained.

FIG. 16A shows the biochemical response of FAD-GDHα F406Y to varying concentrations of glucose (rhombus), and xylose (rectangle). FIG. 16B shows the biochemical response of F406Y to glucose and the non-linear fit through which $K_m$ (k) and $V_{max}$ have been obtained. F406Y enzyme activity was determined via monitoring decrease of Dichlorophenolindophenol (DCIP) signal at $OD_{600}$. FIG. 16C shows electrochemical data representing the current response of the biosensor to various glucose concentrations (shown as a rhombus) and the linear fit across the data range is represented by the $R^2$ value.

FIG. 17A shows the biochemical response of FAD-GDHα F406V to varying concentrations of glucose (rhombus), and xylose (rectangle). FIG. 17B shows the biochemical response of F406V to glucose and the non-linear fit through which $K_m$ (k) and $V_{max}$ have been obtained. F406V enzyme activity was determined via monitoring decrease of Dichlorophenolindophenol (DCIP) signal at $OD_{600}$. FIG. 17C shows electrochemical data representing the current response of the biosensor to various glucose concentrations (shown as a rhombus) and the linear fit across the data range is represented by the $R^2$ value.

FIG. 18A shows the biochemical response of FAD-GDHα F406P to varying concentrations of glucose (rhombus), and xylose (rectangle). FIG. 18B shows the biochemical response of F406P to glucose and the non-linear fit through which $K_m$ (k) and $V_{max}$ have been obtained. F406P enzyme activity was determined via monitoring decrease of Dichlorophenolindophenol (DCIP) signal at $OD_{600}$. FIG. 18C shows electrochemical data representing the current response of the biosensor to various glucose concentrations (shown as a rhombus) and the linear fit across the data range is represented by the $R^2$ value.

FIG. 19A shows electrochemical data representing the current response of the biosensor comprising of FAD-GDHα N215G to various glucose concentrations (shown as a square) and the linear fit across the data range is represented by the $R^2$ value. FIG. 19B shows the non-linear fit of the data shown in FIG. 19A, from which $K_m$ (k) and $V_{max}$ have been calculated.

FIG. 20A shows electrochemical data representing the current response of the biosensor comprising of FAD-GDHα N215H to various glucose concentrations (shown as a square) and the linear fit across the data range is represented by the $R^2$ value. FIG. 20B shows the non-linear fit of the data shown in FIG. 20A, from which $K_m$ (k) and $V_{max}$ have been calculated.

FIG. 21A shows electrochemical data representing the current response of the biosensor comprising of FAD-GDHα N215T to various glucose concentrations (shown as a square) and the linear fit across the data range is represented by the $R^2$ value. FIG. 21B shows the non-linear fit of the data shown in FIG. 21A, from which $K_m$ (k) and $V_{max}$ have been calculated.

FIG. 22A shows electrochemical data representing the current response of the biosensor comprising of FAD-GDHα N215D to various glucose concentrations (shown as a square) and the linear fit across the data range is represented by the $R^2$ value. FIG. 22B shows the non-linear fit of the data shown in FIG. 22A, from which $K_m$ (k) and $V_{max}$ have been calculated.

FIG. 23A shows electrochemical data representing the current response of the biosensor comprising of FAD-GDHα N215Y to various glucose concentrations (shown as a square) and the linear fit across the data range is represented by the $R^2$ value. FIG. 23B shows the non-linear fit of the data shown in FIG. 23A, from which $K_m$ (k) and $V_{max}$ have been calculated.

FIG. 24A shows electrochemical data representing the current response of the biosensor comprising of FAD-GDHα N215S to various glucose concentrations (shown as a square) and the linear fit across the data range is represented by the $R^2$ value. FIG. 24B shows the non-linear fit of the data shown in FIG. 24A, from which $K_m$ (k) and $V_{max}$ have been calculated.

Wherein "I" is the current, S is the substrate concentration, $I_{max}$ is the maximum current and the $K_m$ is the apparent Michaelis constant.

Figure 26A:
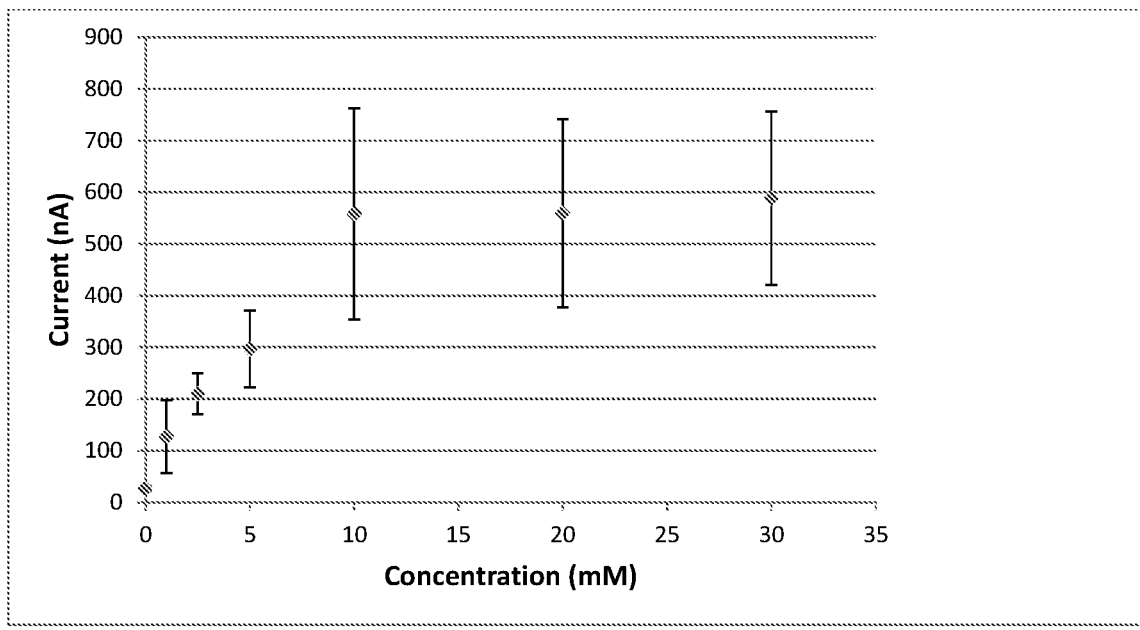
Figure 26B:
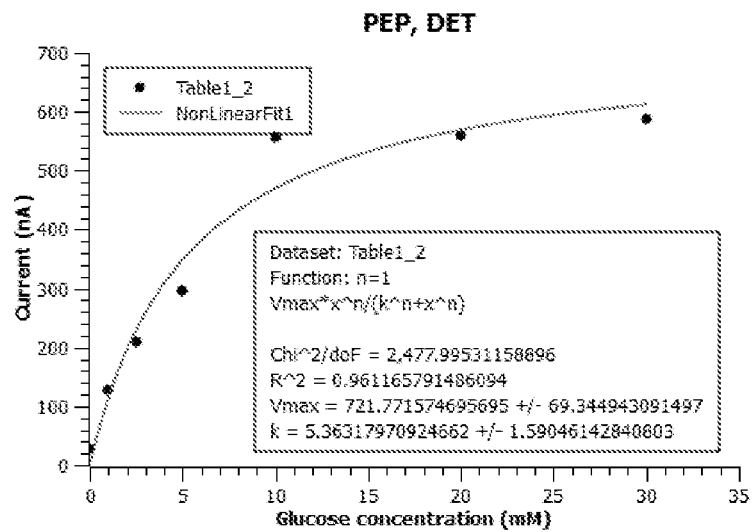

FIG. 26A shows an exemplary embodiment of a bioelectrochemical response of an FAD-GDHα mutant (N177S, N215S, F353L, F406L) of the present invention, varying concentrations of glucose (shown as a rhombus). FIG. 26B shows a bioelectrochemical response of an FAD-GDHα mutant (N177S, N215S, F353L, F406L) of the present invention to glucose and the non-linear fit through which $K_m$ (k) and $V_{max}$ have been calculated. The enzyme activity of FAD-GDHα (N177S, N215S, F353L, F406L) was determined by immobilizing FAD-GDHα (N177S, N215S, F353L, F406L) to a carbon electrode by an electropolymerization method without the addition of an electron mediator.

Figure 27A:
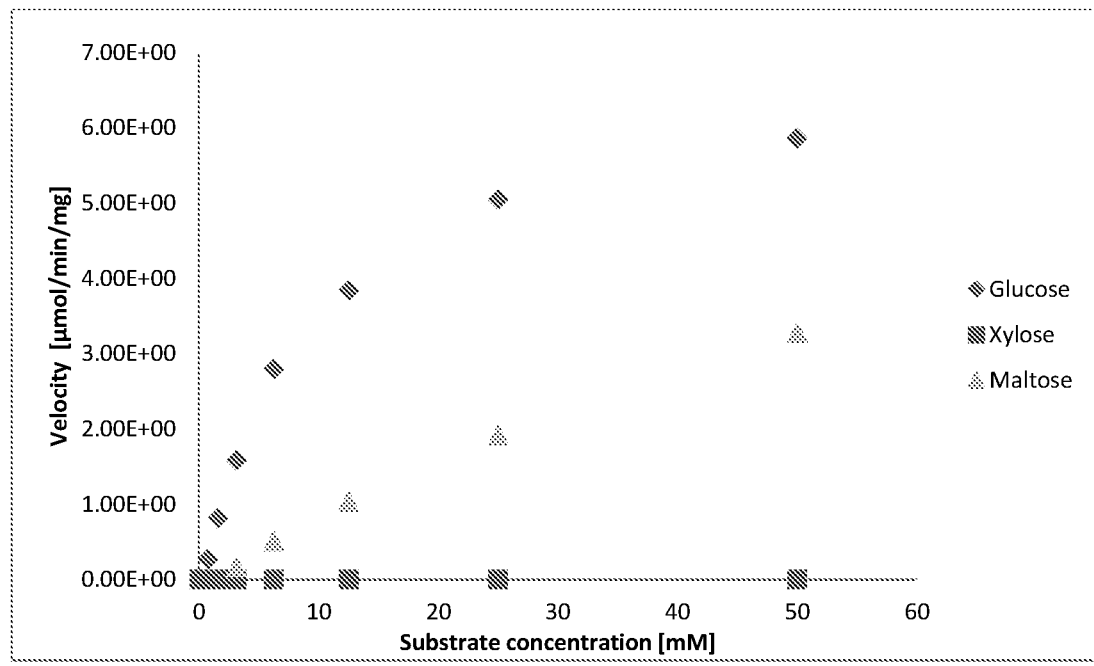
Figure 27B:
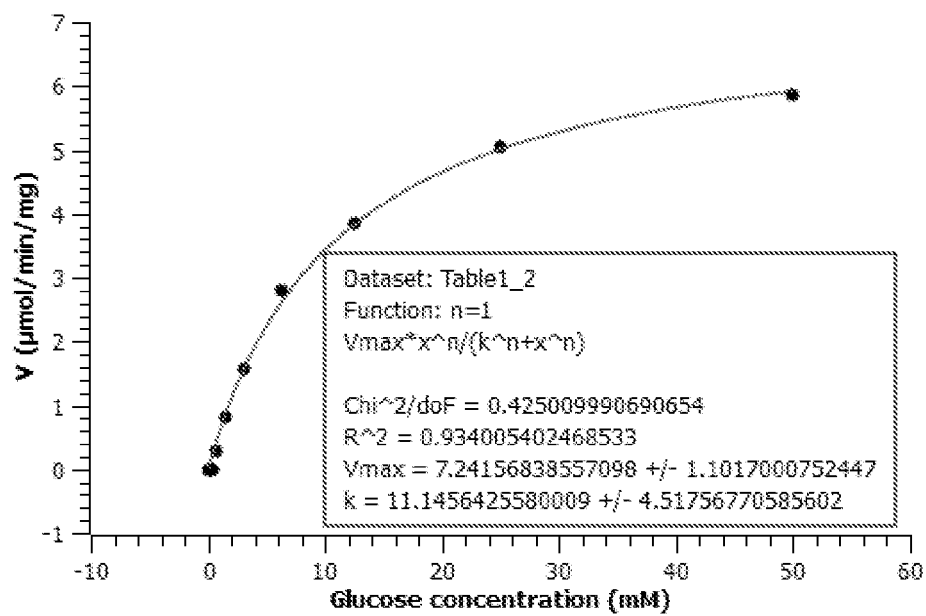

FIG. 27A shows an exemplary embodiment of the present invention, showing a biochemical response of FAD-GDHα (N177S, N215S, F353L, F406L) to varying concentrations of glucose (shown as a rhombus), maltose (shown as a triangle), an xylose (shown as a rectangle). FIG. 27B shows the biochemical response of FAD-GDHα (N177S, N215S, F353L, F406L) to glucose and the non-linear fit through which $K_m$ (k) and $V_{max}$ have been calculated. FAD-GDHα (N177S, N215S, F353L, F406L) activity was determined by monitoring a decrease of dichlorophenolindophenol (DCIP) signal at $OD_{600}$ (Epoch Microplate Spectrophotometer, Biotek).

Figure 28A:
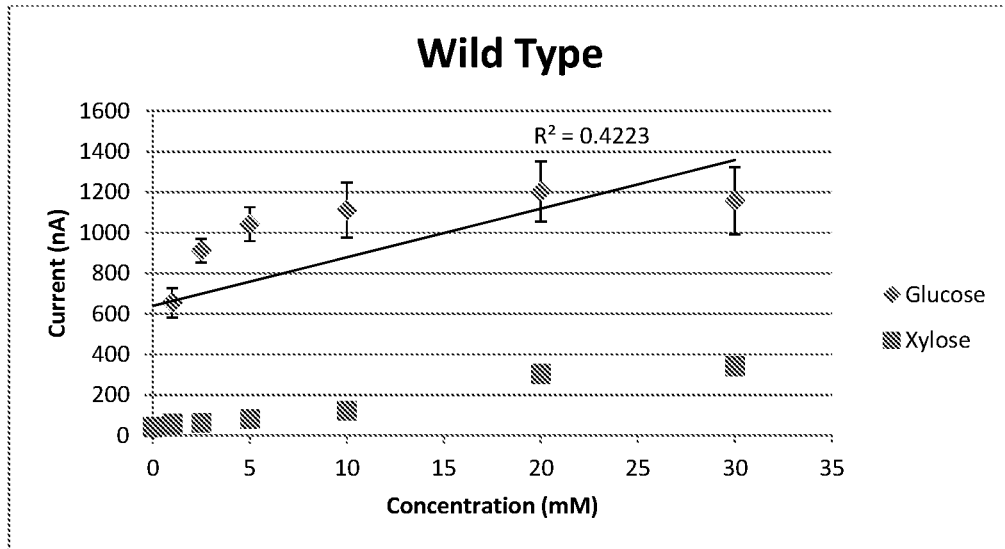
Figure 28B:
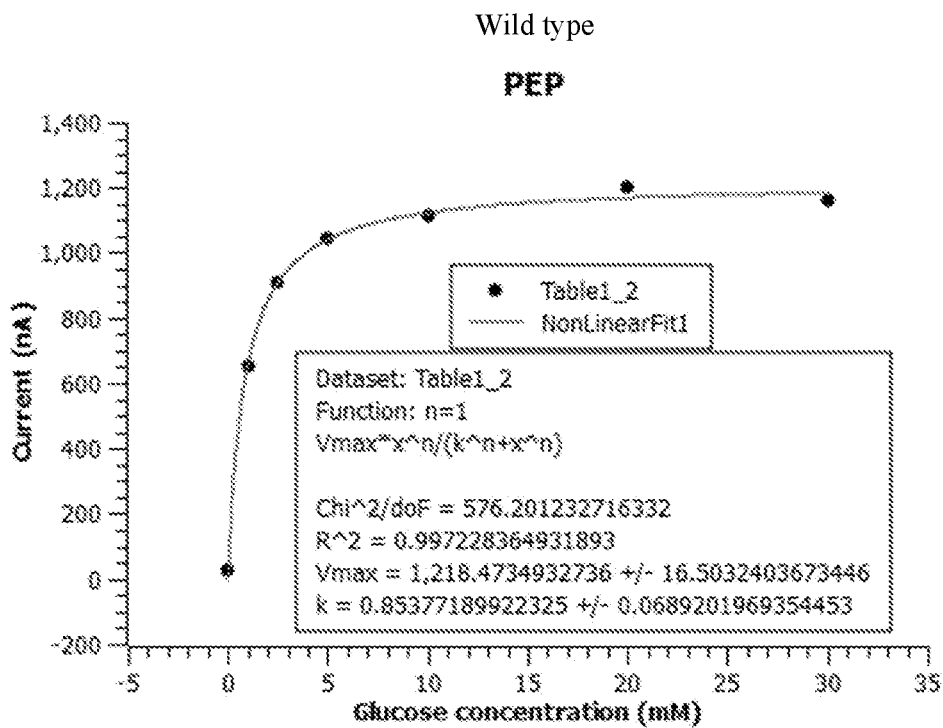

FIGS. 28A and 28B, show an electrochemical response to various substrates. In an exemplary embodiment, FIG. 28A shows electrochemical data representing the current response of the biosensor to various glucose concentrations (shown as a rhombus), maltose concentrations (shown as a triangle) and xylose (shown as a rectangle) concentrations. FIG. 28B shows a biosensor response to glucose and the non-linear fit through which apparent $K_m$ (k) and $V_{max}$ have been calculated. In an exemplary embodiment, wild type FAD-GDHα was immobilized to a carbon electrode via an electropolymerization method as described previously. $R^2$ represents a linear fit of the glucose data. FIG. 28B shows $K_{mapp}$=0.85 mM and $I_{max}$=1218.5 nA.

Figure 29A:
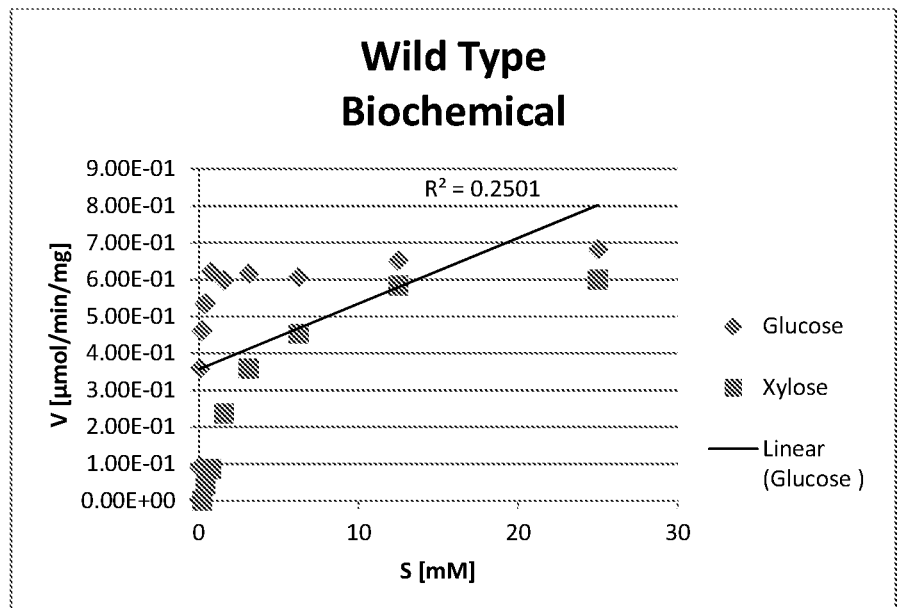

FIG. 29A shows biochemical responses of wild type FAD-GDHα (w.t.), varying concentrations of glucose (rhombus), maltose (triangle) and xylose (rectangle).

Figure 29B:
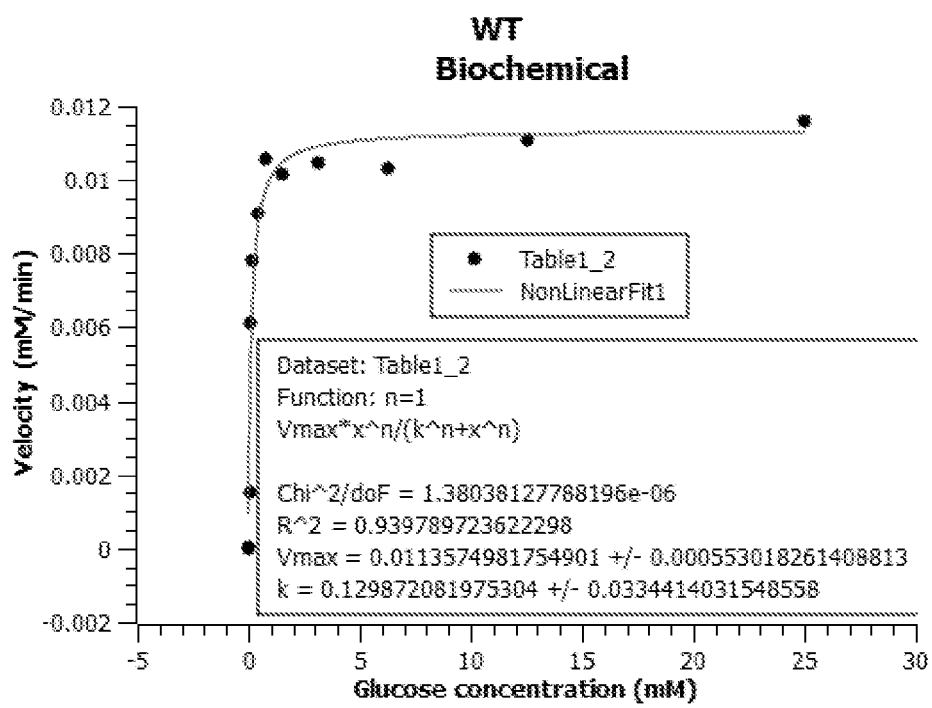

FIG. 29B shows a biochemical response of wild type FAD-GDHα to glucose and the non-linear fit through which $K_m$ (k) and $V_{max}$ have been calculated. The enzyme activity of wild type FAD-GDHα was determined by monitoring the decrease of Dichlorophenolindophenol (DCIP) signal at $OD_{600}$.

Figure 30:
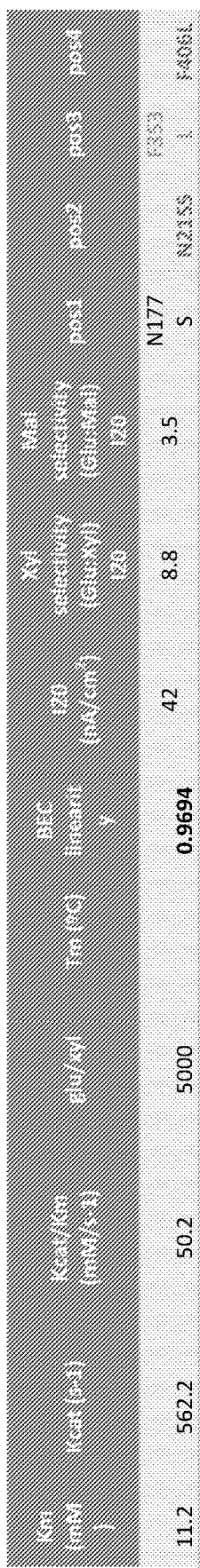

FIG. 30 is a table showing the results obtained from the biochemical and electrochemical experiments characterizing FAD-GDHα (N177S, N215S, F353L, F406L) where: $K_m$ is the Michaelis constant, $K_{cat}$ is the enzyme's catalytic constant, $K_{cat}/K_m$ is the catalytic efficiency, glucose/xylose is the ratio of $K_{catglu}/K_{catxyl}$, BEC linearity is the $R^2$ of the linear fit of the bioelectrochemical experiment, $I_{20}$ is the current flux (nA/cm$^2$) measured when 20 mM of glucose was tested, Xylose selectivity is the ratio of $I_{20glu}/I_{20xyl}$, Maltose selectivity is the ratio of $I_{20glu}/I_{20mal}$, pos1-4, the mutated amino acid number.

Figure 31:
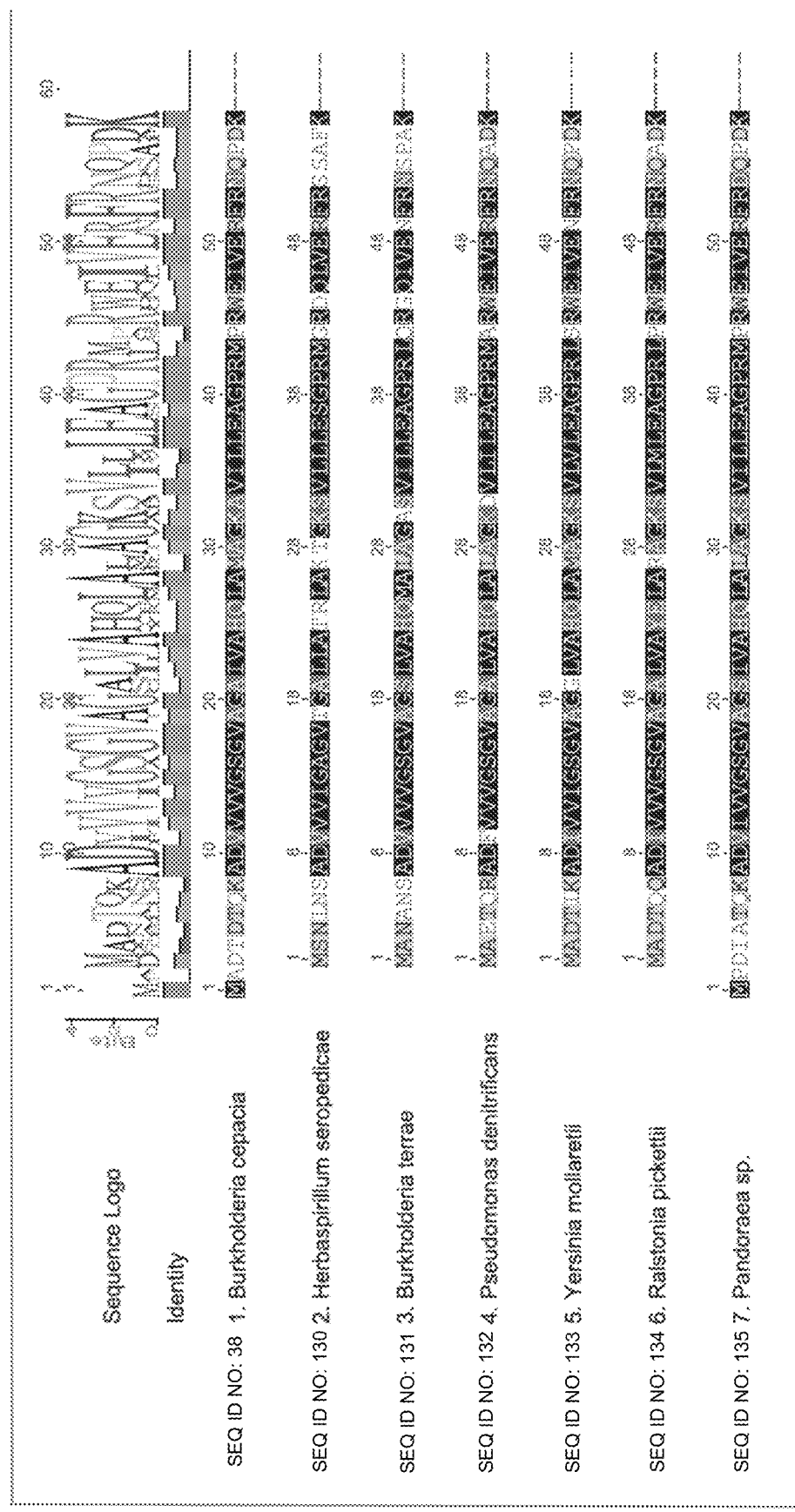
Figure 31:
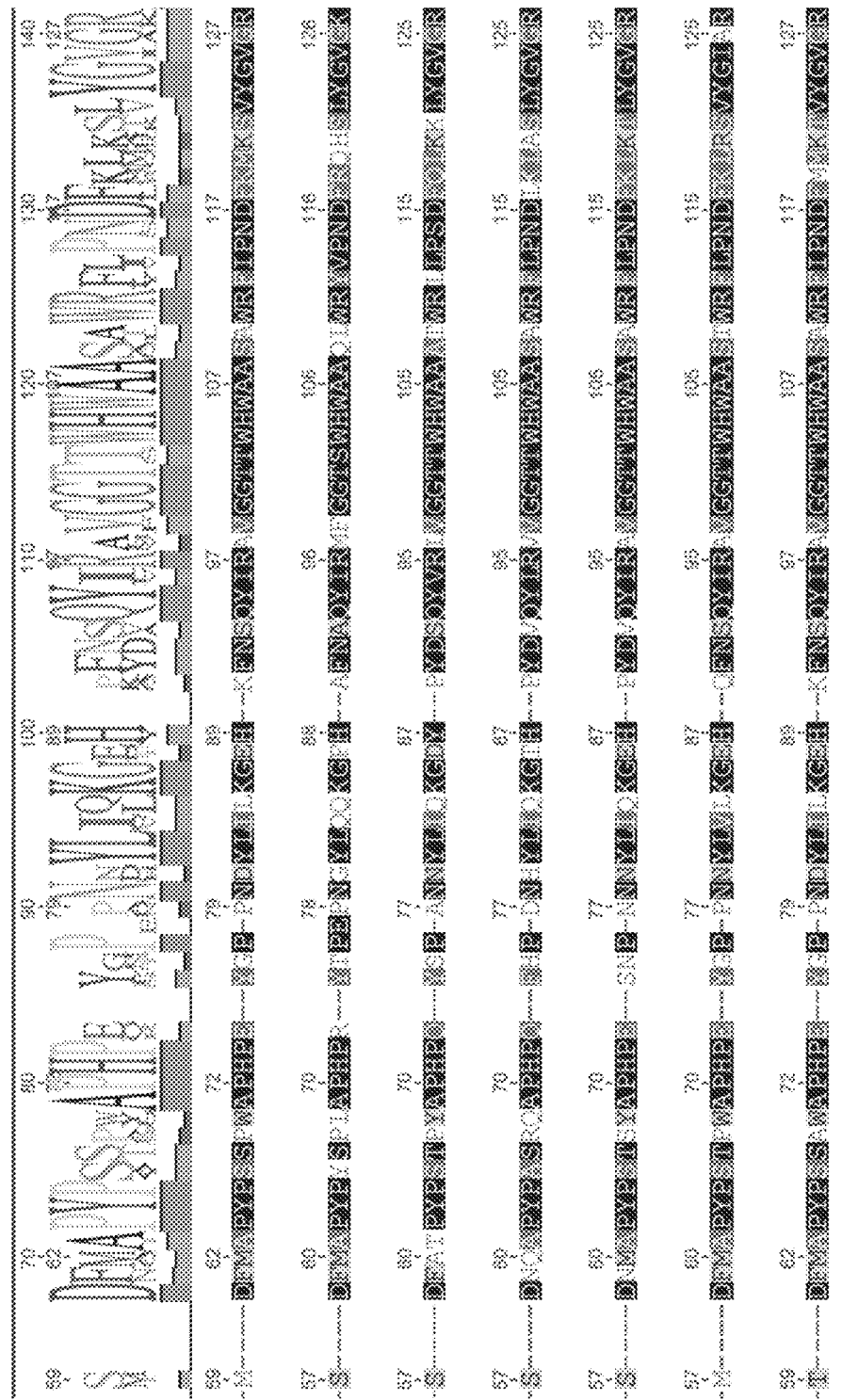
Figure 31:
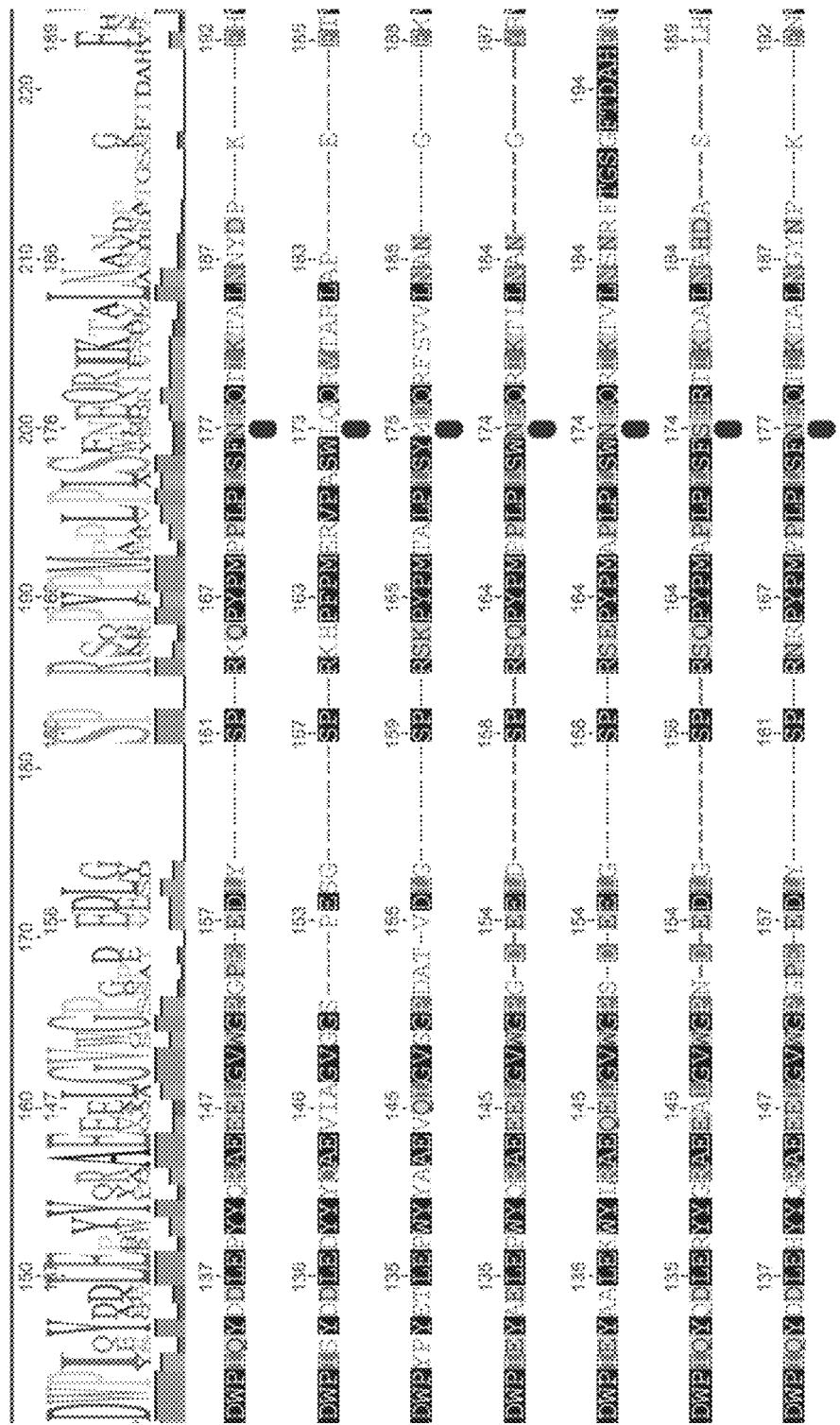
Figure 31:
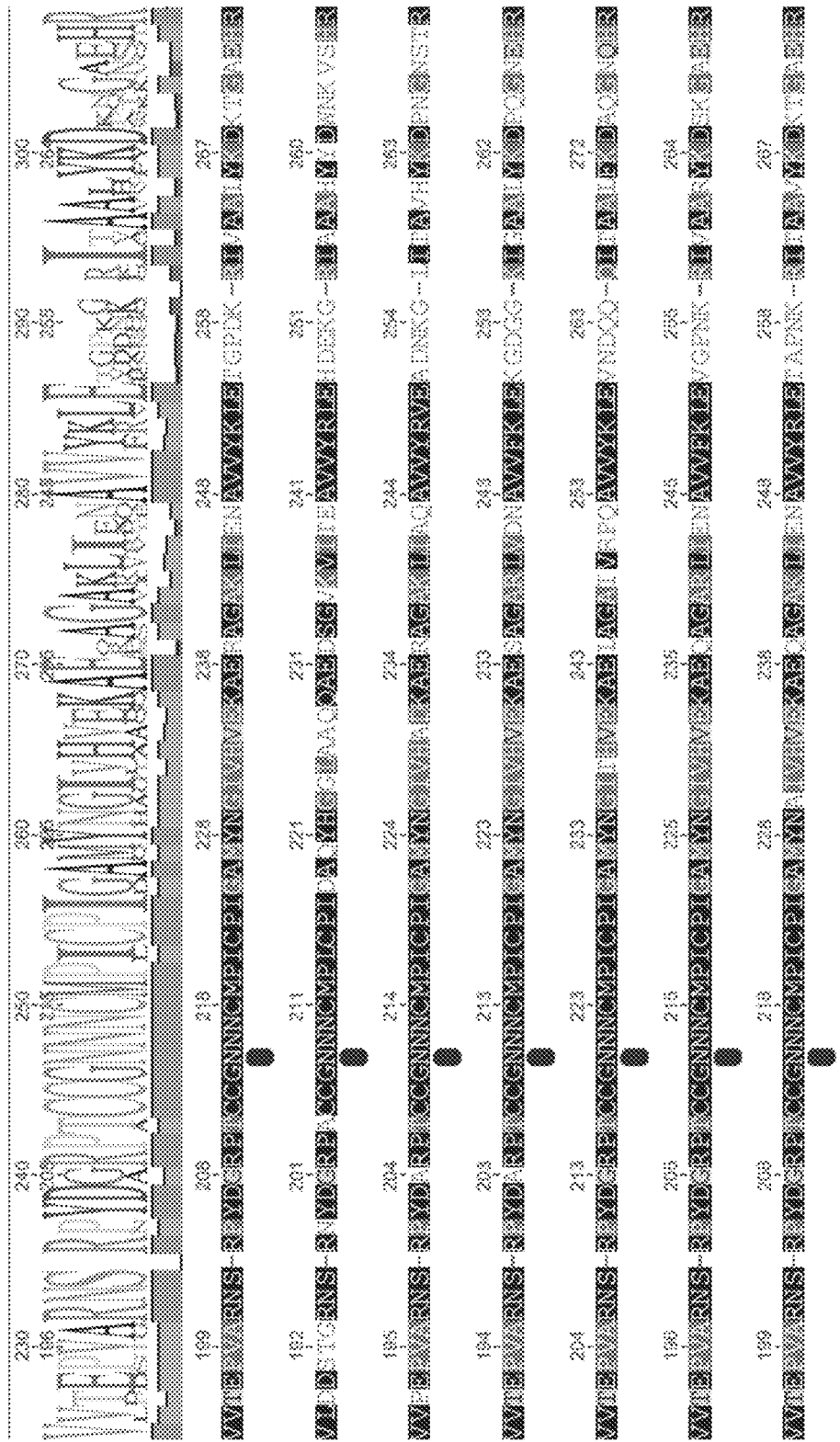
Figure 31:
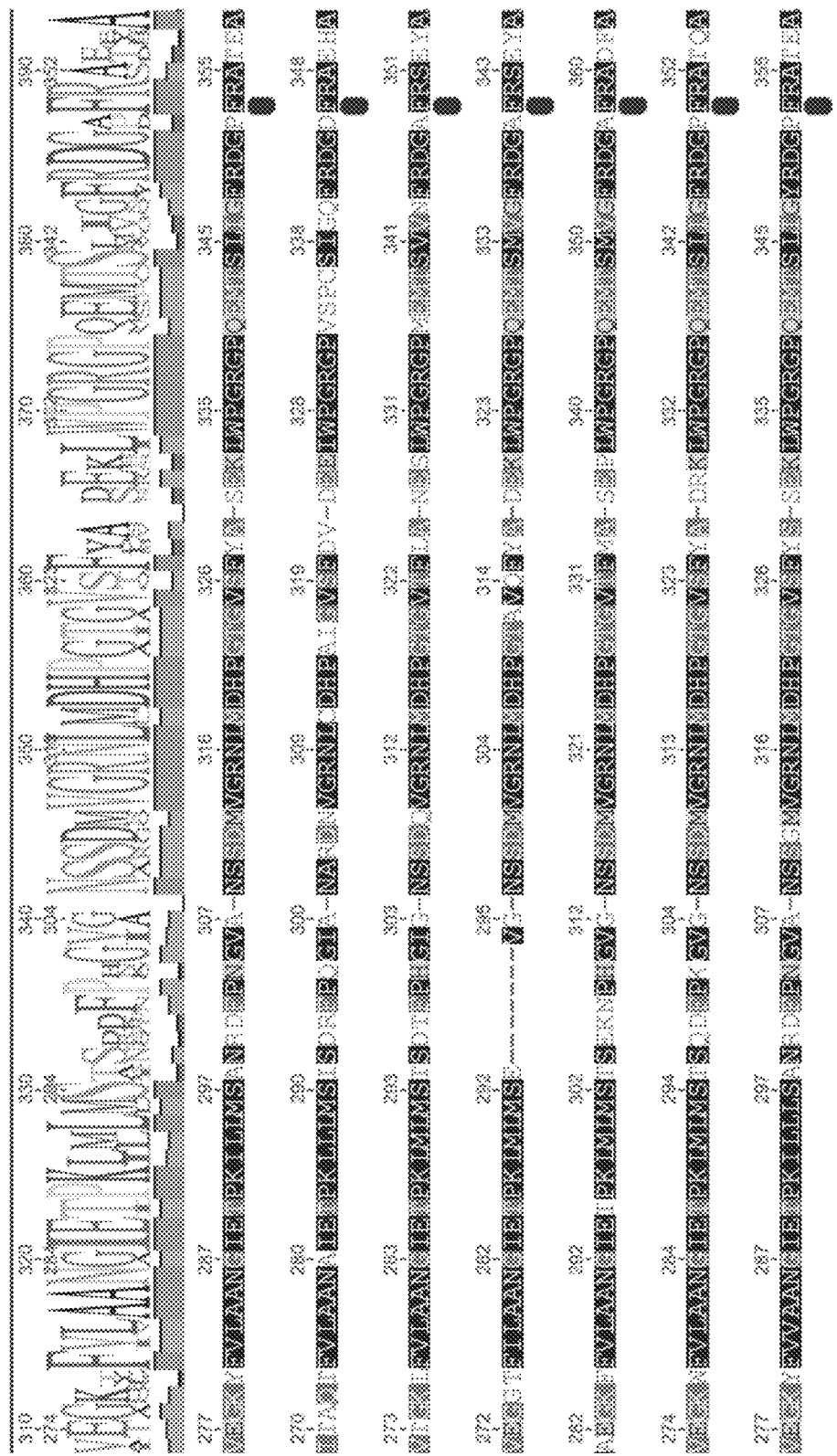
Figure 31:
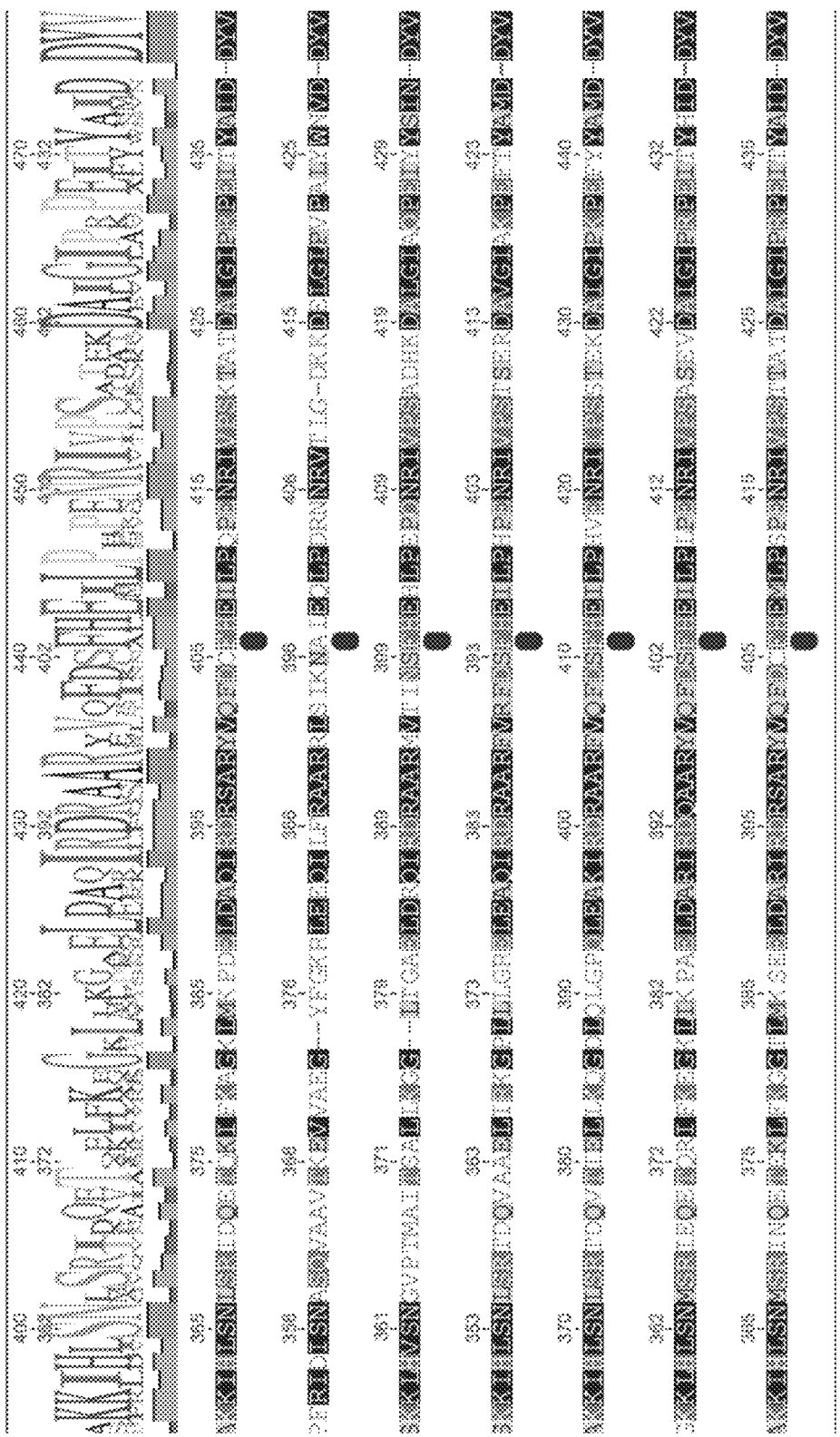
Figure 31:
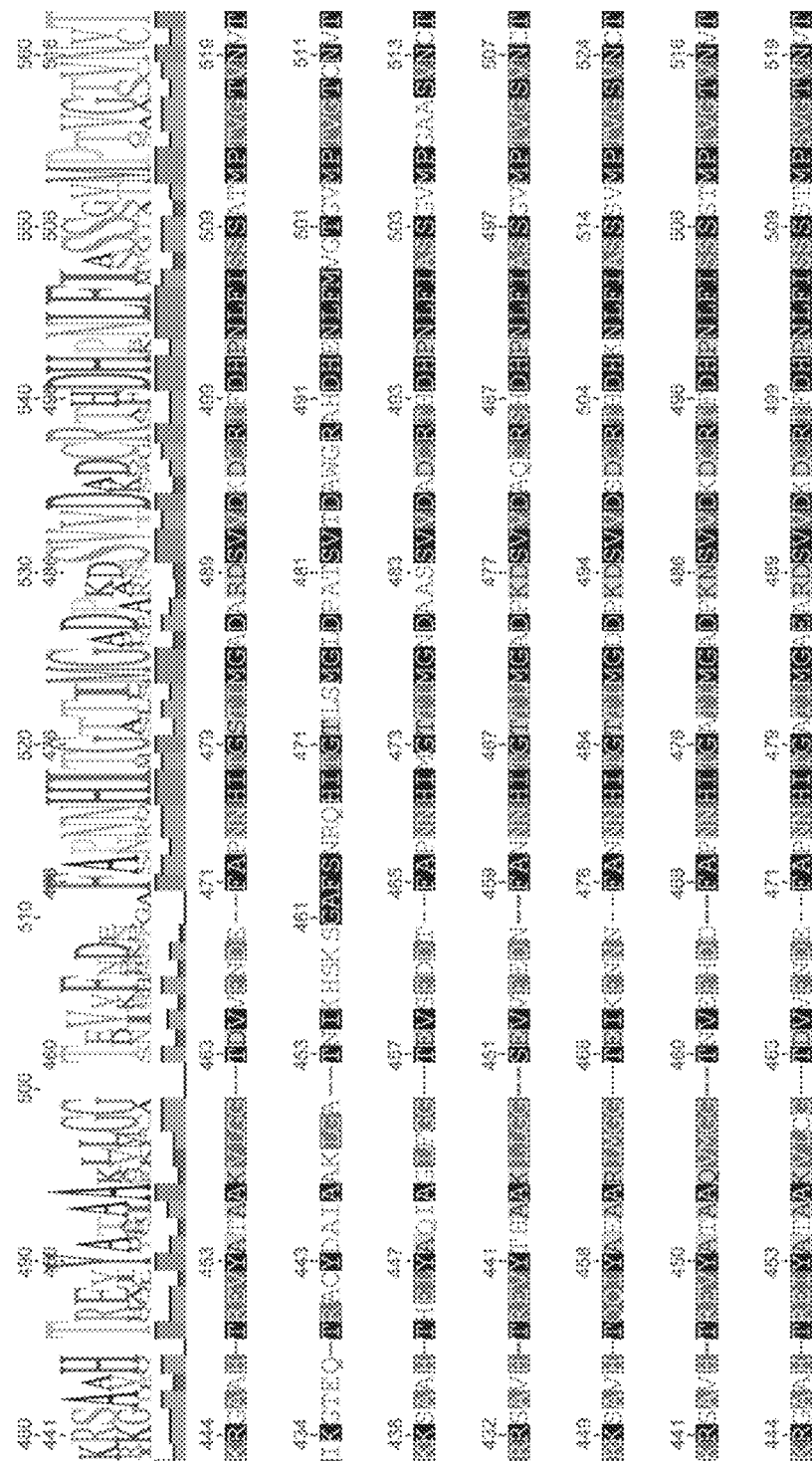
Figure 31:
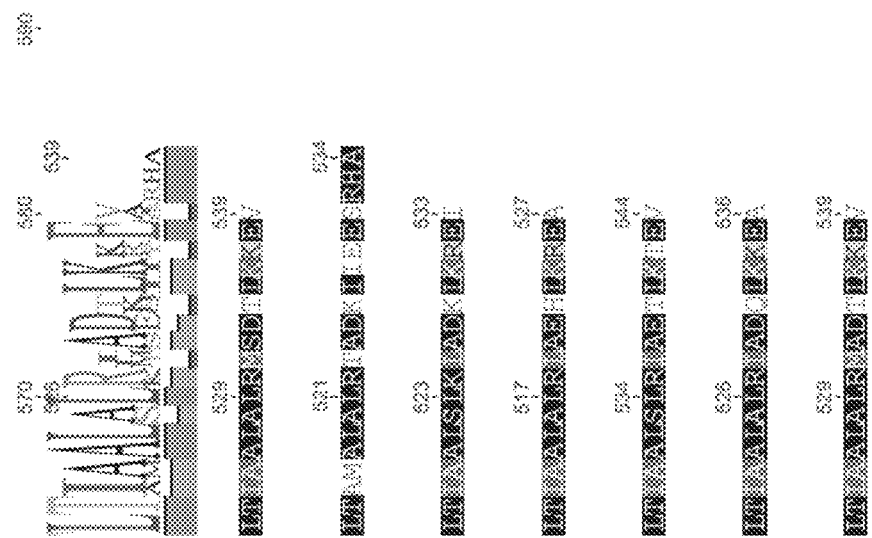

FIG. 31 shows sequence data of several mutated FAD-GDH proteins Burkholderia cepacia, SEQ ID NO.: 38; Herbaspirillum seropedicae, SEQ ID NO.: 130 Burkholderia terrae, SEQ ID NO.: 131; Pseudomonas dentrificans, SEQ ID NO.: 132; Yersinia mollaretii, SEQ ID NO.: 133, Rlastonia Pickettii, SEQ ID NO.: 134; Pandoraea sp., SEQ ID NO.: 135) according to some embodiments of the present invention.

FIG. 32 shows a table of electrochemistry data of the embodiments of the composition of the present invention. Mutations in position 406 provide improved linearity over the entire range of physiological range: F406-S/C/T/V/Y/N/P/L/G/A/I/D/E.

FIG. 33 shows some aspects of some embodiments of the present invention. Mutations in position 406 that provide improved selectivity of glucose: F406-S/C/T/M/V/Y/N/P/L/G/Q/A/I/D/H/E. F406W provides an example of a substitution that reduces the enzyme selectivity towards glucose.

Figure 34A:
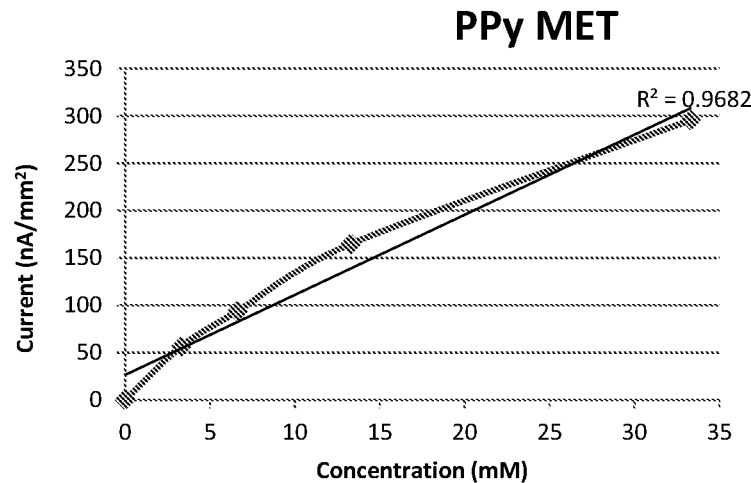
Figure 34B:
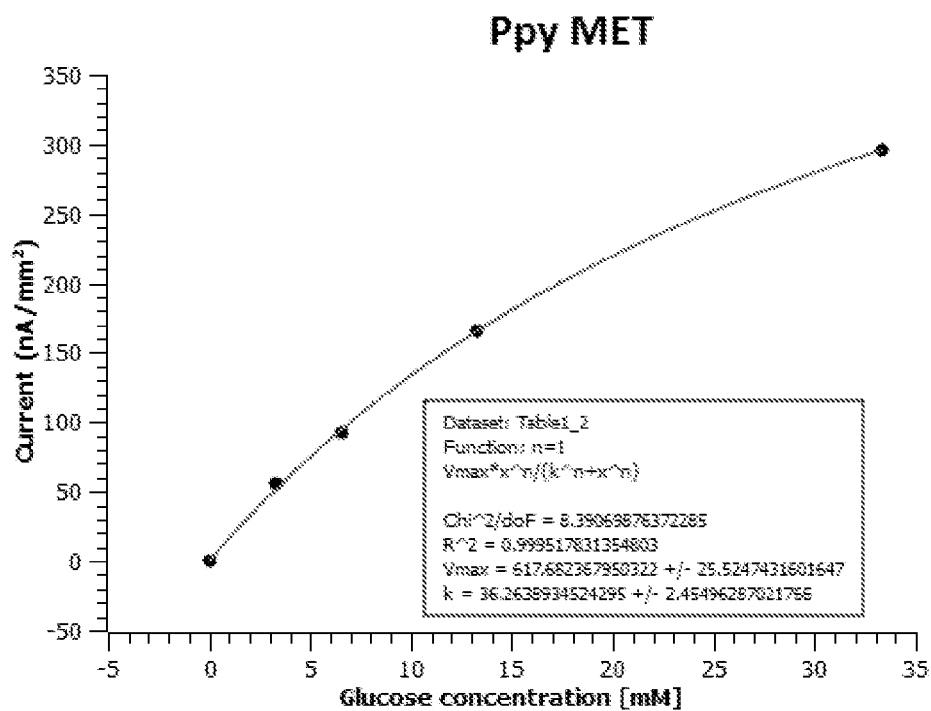

FIG. 34A shows an exemplary embodiment of the present invention, showing electrochemistry data of FAD-GDHα (N177S, N215S, F353L, F406L) to varying concentrations of glucose (shown as a rhombus), using screen-printed electrodes according to some embodiments of the present invention. FIG. 34B shows the non-linear fit (red line) of the data represented in FIG. 34A. $V_{max}$ refers to the maximum current flux, K refers to the apparent $K_m$ value extracted from the Michaelis menten equation.

FIG. 35A shows an exemplary embodiment of the present invention, showing electrochemistry data of FAD-GDHα (N177S, N215S, F353L, F406L) to varying concentrations of glucose (shown as a rhombus), using screen-printed electrodes according to some embodiments of the present invention, via direct electron transfer. FIG. 35B shows the non-linear fit (red line) of the data represented in FIG. 35A. $V_{max}$ refers to the maximum current flux, K refers to the apparent $K_m$ value extracted from the Michaelis menten equation.

Figure 36A:
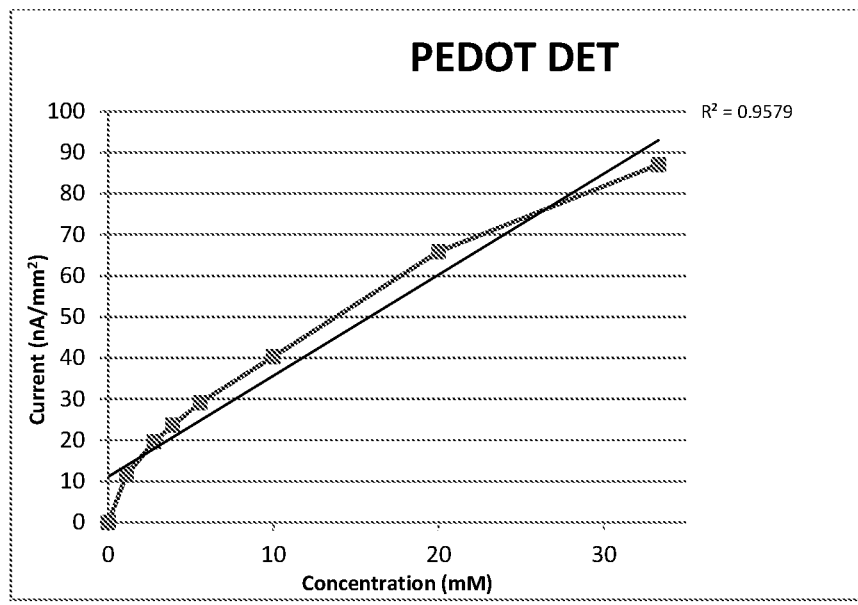
Figure 36B:
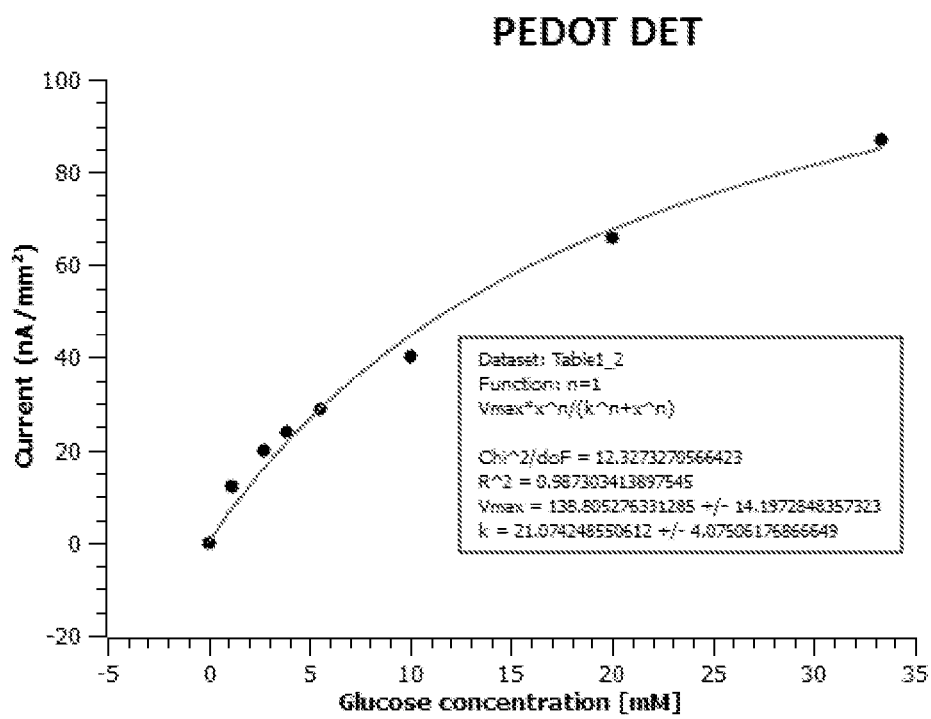

FIG. 36A shows an exemplary embodiment of the present invention, showing electrochemistry data of FAD-GDHα (N177S, N215S, F353L, F406L) to varying concentrations of glucose (shown as a rhombus), using screen-printed electrodes according to some embodiments of the present invention, via direct electron transfer. FIG. 36B shows the non-linear fit (red line) of the data represented in FIG. 36A. $V_{max}$ refers to the maximum current flux, K refers to the apparent $K_m$ value extracted from the Michaelis menten equation.

Figure 37A:
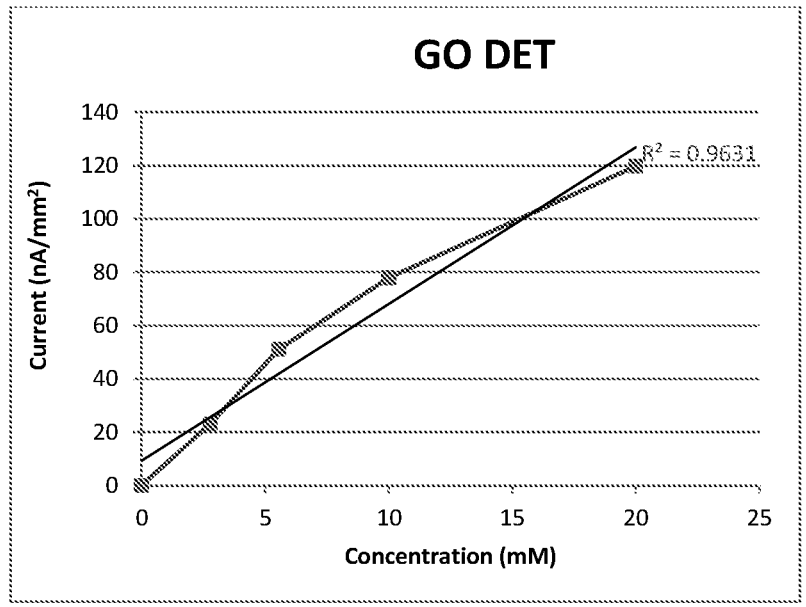
Figure 37B:
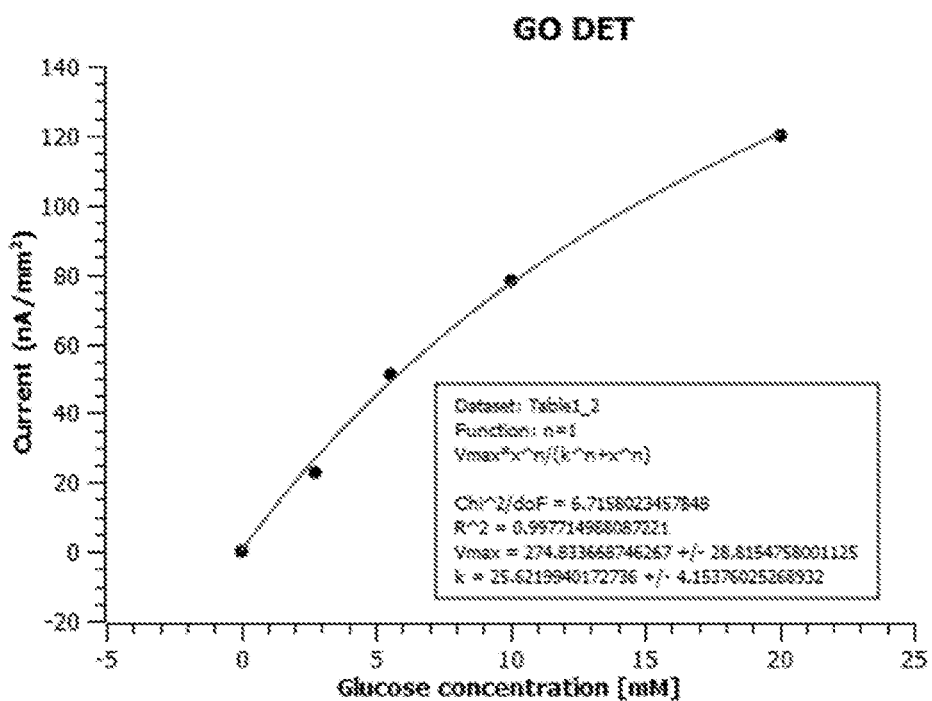

FIG. 37A shows an exemplary embodiment of the present invention, showing electrochemistry data of FAD-GDHα (N177S, N215S, F353L, F406L) to varying concentrations of glucose (shown as a rhombus), using screen-printed electrodes according to some embodiments of the present invention, via direct electron transfer. FIG. 37B shows the non-linear fit (red line) of the data represented in FIG. 37A. $V_{max}$ refers to the maximum current flux, K refers to the apparent $K_m$ value extracted from the Michaelis menten equation.

Figure 38A:
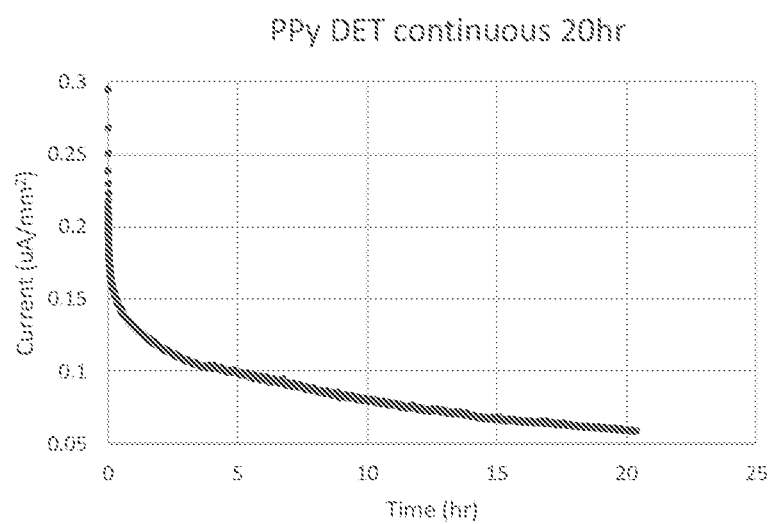
Figure 38B:
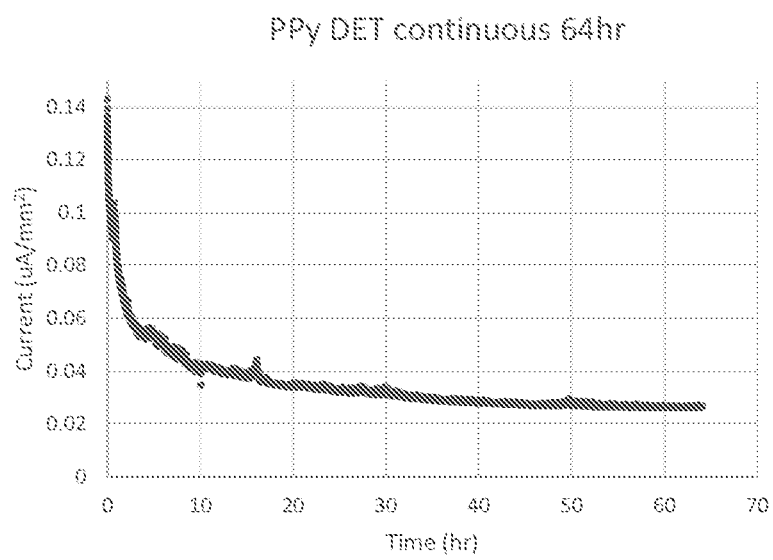

FIGS. 38A and 38B shows an exemplary embodiment of the present invention, showing electrochemistry data of FAD-GDHα (N177S, N215S, F353L, F406L), using an electrode according to some embodiments of the present invention configured to measure glucose levels continuously, for 20 hrs (FIG. 38A), or 64 hr (FIG. 38B).

Figure 39:
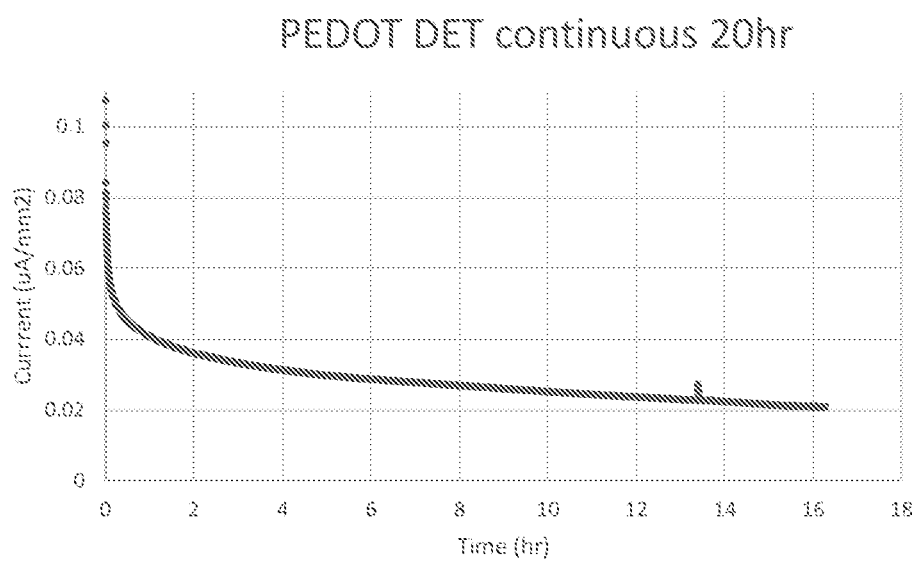

FIG. 39 shows an exemplary embodiment of the present invention, showing electrochemistry data of FAD-GDHα (N177S, N215S, F353L, F406L), using an electrode according to some embodiments of the present invention configured to measure glucose levels continuously, for 20 hrs.

FIG. 40 shows a table of electrochemistry data of the embodiments of the electrodes of the present invention.

Figure 41A:
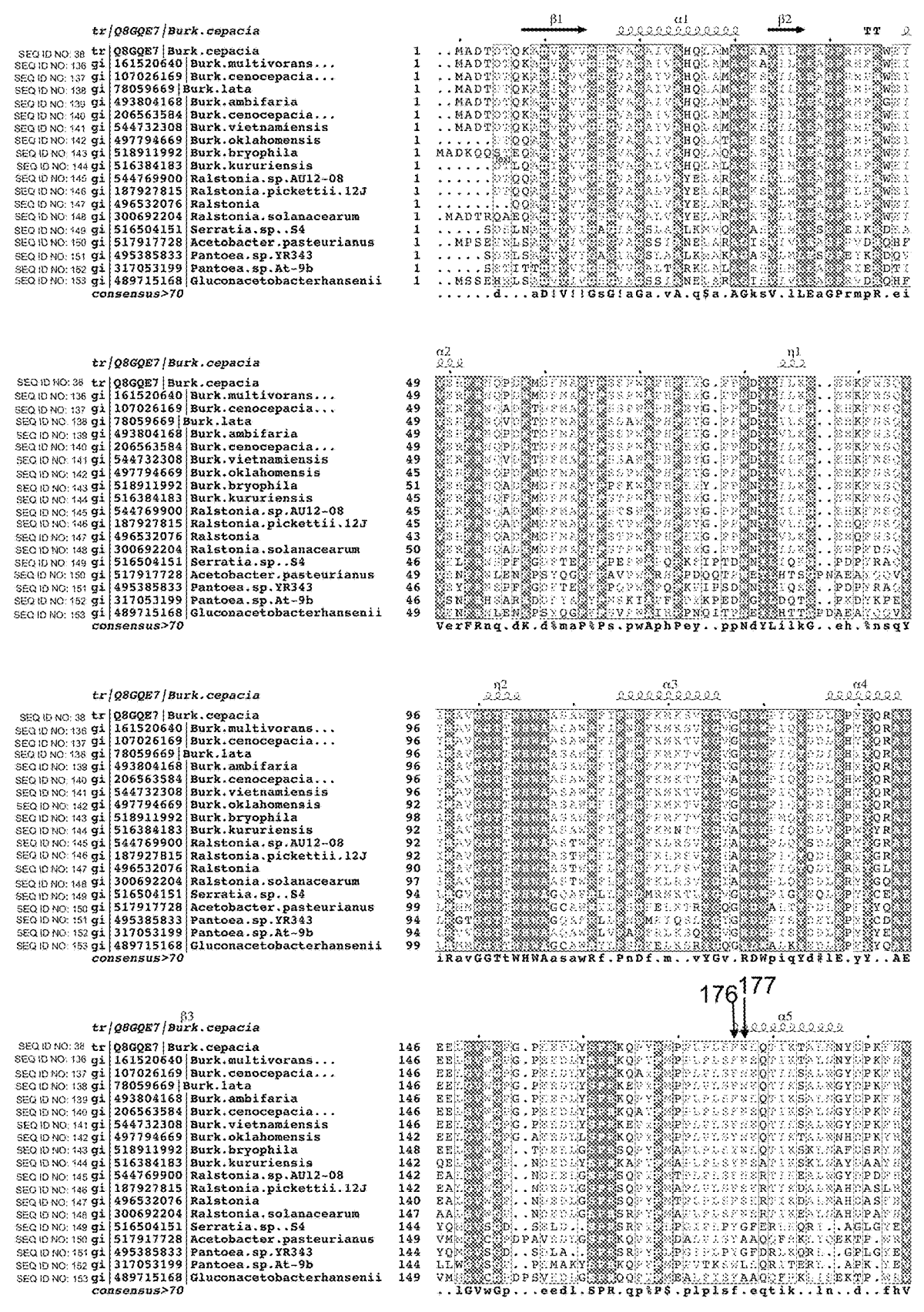
Figure 41B:
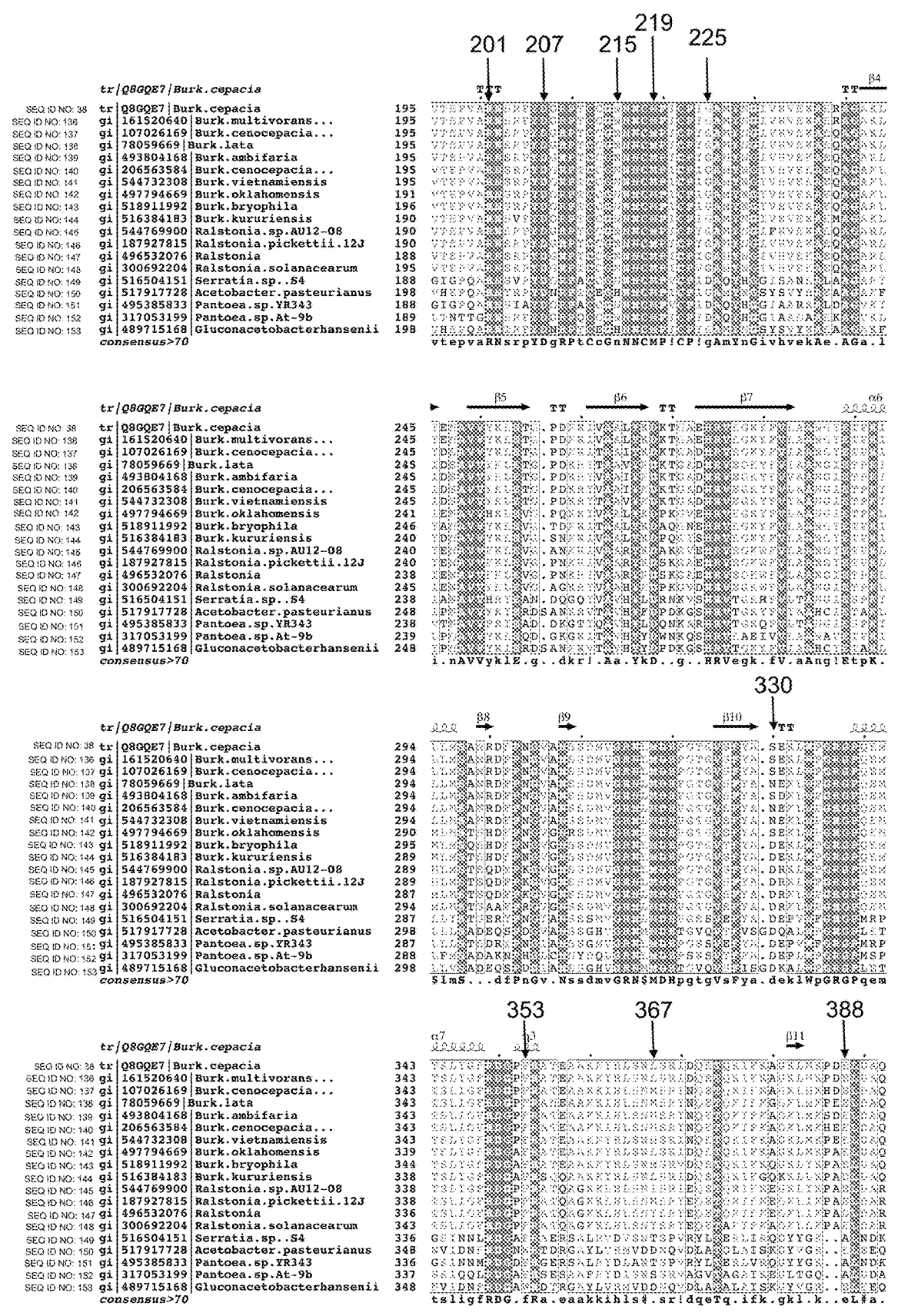
Figure 41C:
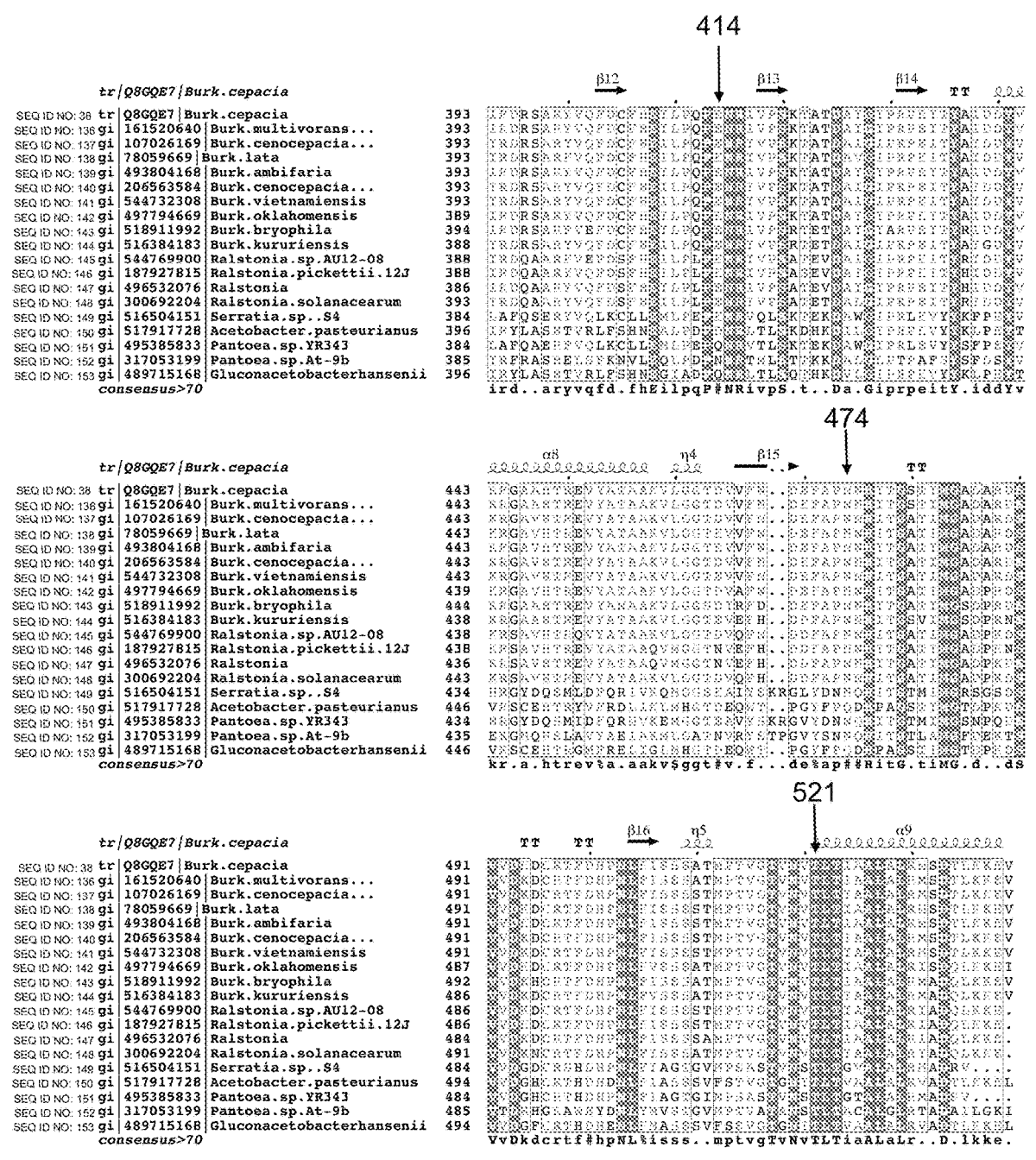

FIGS. 41A to 41C shows a sequence alignment for multiple different FAD-GDHα proteins (SEQ ID NOs: 38, 136-153). For the consensus sequence, uppercase indicates identity, lowercase indicates consensus level of greaters than 0.5, ! is any one of I or V, $ is an one of L or M, % is any one of F or Y, # is any one of NDQEBZ.

Among those benefits and improvements that have been disclosed, other objects and advantages of this invention will become apparent from the following description taken in conjunction with the accompanying figures. Detailed embodiments of the present invention are disclosed herein; however, it is to be understood that the disclosed embodiments are merely illustrative of the invention that may be embodied in various forms. In addition, each of the examples given in connection with the various embodiments of the invention which are intended to be illustrative, and not restrictive.

DESCRIPTION OF EXEMPLARY EMBODIMENTS

The present invention will be further explained with reference to the attached drawings, wherein like structures are referred to by like numerals throughout the several views. The drawings shown are not necessarily to scale, with emphasis instead generally being placed upon illustrating the principles of the present invention. Further, some features may be exaggerated to show details of particular components.

The figures constitute a part of this specification and include illustrative embodiments of the present invention and illustrate various objects and features thereof. Further, the figures are not necessarily to scale, some features may be exaggerated to show details of particular components. In addition, any measurements, specifications and the like shown in the figures are intended to be illustrative, and not restrictive. Therefore, specific structural and functional details disclosed herein are not to be interpreted as limiting, but merely as a representative basis for teaching one skilled in the art to variously employ the present invention.

Throughout the specification and claims, the following terms take the meanings explicitly associated herein, unless the context clearly dictates otherwise. The phrases "in one embodiment" and "in some embodiments" as used herein do not necessarily refer to the same embodiment(s), though it may. Furthermore, the phrases "in another embodiment" and "in some other embodiments" as used herein do not necessarily refer to a different embodiment, although it may. Thus, as described below, various embodiments of the invention may be readily combined, without departing from the scope or spirit of the invention.

In addition, throughout the specification, the meaning of "a," "an," and "the" include plural references. The meaning of "in" includes "in" and "on."

As used herein, "linearity" refers to the $R^2$ value of a linear fit which is calculated for the plot of the relation between substrate concentration and the measured current. In some embodiments, good linearity is considered as an $R^2$ value equal or above 0.85 across the entire range of physiological glucose level (0-600 mg/dL). In some embodiments, good linearity is considered to be an $R^2$ value that is equal or above 0.9 across the entire range of physiological glucose level. In some embodiments, good linearity is considered as an $R^2$ value equal or above 0.95 across the entire range of physiological glucose level. Glucose sensing devices transform the measured current to glucose level using a linear based algorithm. Thus the linear range of the glucose sensing enzyme improves the accuracy of measurement of the blood glucose concentration.

As used herein, "direct electron transfer" means the ability of an enzyme to conduct electrons from its enzymatic core to an electrode, during catalysis, generating a detectable current.

The flavoprotein Glucose dehydrogenase (FAD-GDH, EC 1.1.5.9) is quite recently utilized as a glucose sensing enzyme in glucose test strips. The FAD-GDH catalyzes the oxidation of glucose through the use of various electron acceptors (such as Dichlorophenolindophenol).

To date FAD-GDH has been isolated from gram negative bacteria (*Burkholderia cepacia*), fungi (*Aspergillus* sp., *A. oryzae*, *A. niger*, *A. terreus*) and from insects (*Drosophila melanogaster*, *Anopheles gambiae*, *Apis mellifera*, *Tribolium castaneum*).

The protein is composed of three subunits: a catalytic subunit harboring FAD at its redox center (alpha, 67 kDa), a multiheme electron-transfer subunit (beta, 43 kDa) and a chaperon subunit (gamma, 20 kDa). The alpha subunit can be recombinantly expressed and purified in *E. Coli* independently of the other subunits, as well as with the beta and the gamma subunits while maintaining catalytic activity in either cases. FAD-GDH is an enzyme that catalyses the oxidation of glucose in the presence of an electron acceptor, such as 2,6-dichlorophenolindophenol or potassium ferricyanide. FAD-GDH can be used in analyte detection assays. FAD-GDH is comprised of multiple subunits, including the catalytic subunit alpha.

In some embodiments the FAD-GDH of the present invention, including all mutants described in the present invention, can be expressed with a beta (β) subunit (a cytochrome domain) in tandem or on a different plasmid, expressed and purified to generate a protein which can deliver improved electron transfer to various biosensor applications. In some embodiments, the FAD-GDH of the present invention can be expressed and purified without a beta (β) subunit, as further detailed below.

In some embodiments, analyte detection assays, e.g., glucose detection assays, can be based on the production of hydrogen peroxide and the subsequent detection thereof. For example, glucose is quantitated using assays by first oxidizing glucose with glucose oxidase to produce gluconic acid and hydrogen peroxide. The resultant hydrogen peroxide, in conjunction with a peroxidase, causes the conversion of one or more organic substrates, i.e. an indicator, into a chromogenic product, which product is then detected and related to the glucose concentration in the initial sample.

In the present invention, the inventors have mutated the alpha subunit and co-expressed it with a native gamma subunit. The artificially mutated FAD-GDH alpha (FAD-GDHα) subunit of the present invention can be co-expressed with either a native or a mutated gamma subunit, beta subunit, or both. For example, in some embodiments, the enzyme electrode, configured to measure the amount of glucose in a physiological fluid, comprising the mutated FAD-GDHα protein according to some embodiments of the present invention immobilized onto the electrode further comprises at least one subunit selected from the group consisting of: wild-type FAD-GDHβ subunit, and a wild-type FAD-GDHγ subunit.

In some embodiments, the present invention is a mutated FAD-GDHα protein, wherein the mutated FAD-GDHα protein is mutated from a wild-type first species to contain at least one point mutation, wherein the mutated FAD-GDHα protein comprises: $P(X)_{n=8}X^4(X)_{n=16}V(X)_{n=6}$ $RN(X)_{n=3}YDXRPXCXGX^3NNCMP(X)_{n=1}CP(X)_{n=2}$ $A(X)_{n=1}Y(X)_{n=1}G(X)_{n=6}A(X)_{n=2}AG(X)_{n=6}AVV(X)_{n=3}$ $E(X)_{n=8-9}A(X)_{n=2}Y(X)_{n=1}D(X)_{n=5}HRV(X)_{n=5}V(X)_{n=2}$ $A(X)_{n=3}E(X)_{n=2}K(X)_{n=4}S(X)_{n=5}P(X)_{n=1}G(X)_{n=2}N(X)_{n=4}$ $GRN(X)_{n=1}MDH(X)_{n=4}V(X)_{n=1}F(X)_{n=6-7}W(X)_{n=1}GRGP$ $(X)_{n=9}RDGXX^5R(X)_{n=19}T(X)_{n=14}L(X)_{n=14}X^2(X)_{n=1}$ $X^1(X)_{n=1}E(X)_{n=4}P(X)_{n=1}NR(X)_{n=3}S(X)_{n=4}D(X)_{n=2}G(X)_{n=7}$ $Y(X)_{n=4}Y(X)_{n=32-35}$, wherein each X represents a wild-type amino acid residue of the first species and n indicates the number of the wild-type amino acid residues of the first species represented by a respective parenthetical at that position, wherein:
  a) $X^1$ is selected from the group consisting of X, S, C, T, M, V, Y, N, P, L, G, Q, A, I, D, W, H, and E, wherein if $X^1$ is L, H or V, then $X^2$ is D;
  b) $X^3$ is selected from the group consisting of G, H, D, Y, S, and X;
  c) $X^4$ is selected from the group consisting of S and X; and
  d) $X^5$ is selected from the group consisting of L and X.
In some embodiments,
  a) $X^1$ is selected from the group consisting of S, C, T, M, V, Y, N, P, L, G, Q, A, I, D, W, H, and E, wherein if $X^1$ is L, H or V, then $X^2$ is D;
  b) $X^3$ is selected from the group consisting of G, H, D, Y, S, and X;
  c) $X^4$ is selected from the group consisting of S and X; and
  d) $X^5$ is selected from the group consisting of L and X.
In some embodiments,
  a) $X^1$ is selected from the group consisting of S, C, T, M, V, Y, N, P, L, G, Q, A, I, D, W, H, and E, wherein if $X^1$ is L, H or V, then $X^2$ is D;
  b) $X^3$ is selected from the group consisting of G, H, D, Y, S, and X;
  c) $X^4$ is X; and
  d) $X^5$ is X.
In some embodiments,
  a) $X^1$ is selected from the group consisting of S, C, T, M, V, Y, N, P, L, G, Q, A, I, D, W, H, and E, wherein if $X^1$ is L, H or V, then $X^2$ is D;
  b) $X^3$ is X;
  c) $X^4$ is X; and
  d) $X^5$ is X.
In some embodiments,
  a) $X^1$ is X;
  b) $X^3$ is selected from the group consisting of G, H, D, Y, S, and X;
  c) $X^4$ is X; and
  d) $X^5$ is X.
In some embodiments,
  a) $X^1$ is selected from the group consisting of S, C, T, M, V, Y, N, P, L, G, Q, A, I, D, W, H, and E, wherein if X is L, H or V, then $X^2$ is D;

b) $X^3$ is selected from the group consisting of G, H, D, Y, and S;
c) $X^4$ is S; and
d) $X^5$ is X.

In some embodiments,
a) $X^1$ is selected from the group consisting of S, C, T, M, V, Y, N, P, L, G, Q, A, I, D, W, H, and E, wherein if $X^1$ is L, H or V, then $X^2$ is D;
b) $X^3$ is selected from the group consisting of G, H, D, Y, and S;
c) $X^4$ is X; and
d) $X^5$ is L.

In some embodiments,
a) $X^1$ is selected from the group consisting of S, C, T, M, V, Y, N, P, L, G, Q, A, I, D, W, H, or E, wherein if $X^1$ is L, H or V, then $X^2$ is D;
b) $X^3$ is X;
c) $X^4$ is S; and
d) $X^5$ is L.

In some embodiments,
a) $X^1$ is selected from the group consisting of S, C, T, M, V, Y, N, P, L, G, Q, A, I, D, W, H, or E, wherein if $X^1$ is L, H or V, then $X^2$ is D;
b) $X^3$ is selected from the group consisting of G, H, D, Y, and S;
c) $X^4$ is S; and
d) $X^5$ is L.

In some embodiments, the amino acid sequence of the mutated FAD-GDHα protein comprises the amino acid sequence set forth in any one of SEQ ID NOS: 9-29, SEQ ID NOS: 46-104, or SEQ ID NOS: 105-129.

In some embodiments, a biochemical activity is increased at least 10% compared to a non-mutated FAD-GDHα protein from the wild type first species.

In some embodiments, a selectivity for glucose is increased at least 10% compared to a non-mutated FAD-GDHα protein from the wild type first species.

In some embodiments, a linearity of current as a function of glucose concentration is increased at least 10% compared to a non-mutated FAD-GDHα protein from the wild type first species.

In some embodiments, the FAD-GDHα protein has at least one point mutation, wherein the point mutation can be at any one of the amino acid residues selected from the group consisting of: amino acid 177, amino acid 215, amino acid 353, and amino acid 406.

In some embodiments, the FAD-GDHα protein has a point mutation at amino acid 406, and at least one additional point mutation, wherein the at least one additional point mutation can be at any one of the amino acid residues selected from the group consisting of: amino acid 177, amino acid 215, and amino acid 353.

In some embodiments, the FAD-GDHα protein has point mutations at amino acids 177, 215, and 406.

In some embodiments, the FAD-GDHα protein has point mutations at amino acids 215, 353, and 406.

In some embodiments, the FAD-GDHα protein has point mutations at amino acids 177, 215, 353, and 406.

A person of ordinary skill in the art would understand that to create a protein with Flavin Adenine Dinucleotide—Glucose Dehydrogenase alpha subunit (FAD-GDHa) activity according to the instant invention, one would select amino acid residues for such a protein based on the amino acid sequence of a naturally-occurring FAD-GDHα protein. The amino acid residues specified in the above sequences (i.e. those residues not identified by "X") represent residues that are conserved among FAD-GDHα proteins. Such residues serve as a reference point to better specify for the person of ordinary skill in the art the location of amino acid residues in naturally-occurring FAD-GDHα (i.e. those identified herein as "$X^1$" and "$X^2$") which can be mutated to create a non naturally-occurring FAD-GDHα protein with improved properties.

In some embodiments, the FAD-GDHα proteins of the instant invention includes at least one mutation (e.g., a point mutation) in the amino acid sequence, e.g., SEQ ID NOs: 3-8, e.g., as shown in Tables 2 to 6. In some embodiments, the mutation is located at methionine 43 of FAD-GDHa. In some embodiments, the mutation is located at isoleucine 346 of FAD-GDHa. In some embodiments, the mutation is located at serine 420 of FAD-GDHa. In some embodiments, the mutation is located at serine 365 of FAD-GDHa. In some embodiments, the mutation is located at glycine 208 of FAD-GDHa. In some embodiments, the mutation is located at threonine 521 of FAD-GDHa. In some embodiments, the mutation is located at valine 306 of FAD-GDHa. In some embodiments, the mutation is located at glutamine 412 of FAD-GDHa. In some embodiments, the mutation is located at arginine 416 of FAD-GDHa. In some embodiments, the mutation is located at asparagine 215 of FAD-GDHa. In some embodiments, the mutation is located at alanine 487 of FAD-GDHa. In some embodiments, the mutation is located at asparagine 116 of FAD-GDHa. In some embodiments, the mutation is located at asparagine 177 of FAD-GDHa. In some embodiments, the mutation is located at methionine 219 of FAD-GDHa. In some embodiments, the mutation is located at aspartic acid 440 of FAD-GDHa. In some embodiments, the mutation is located at serine 330 of FAD-GDHa. In some embodiments, the mutation is located at proline 257 of FAD-GDHa. In some embodiments, the mutation is located at asparagine 474 of FAD-GDHa. In some embodiments, the mutation is located at threonine 521 of FAD-GDHa. In some embodiments, the mutation is located at serine 420 of FAD-GDHa. In some embodiments, the mutation is located at serine 365 of FAD-GDHa. In some embodiments, the mutation is located at isoleucine 261 of FAD-GDHa. In some embodiments, the mutation is located at threonine 521 of FAD-GDHa. In some embodiments, the mutation is located at proline 173 of FAD-GDHa. In some embodiments, the mutation is located at methionine 219 of FAD-GDHa. In some embodiments, the mutation is located at aspartic acid 301 of FAD-GDHa. In some embodiments, the mutation is located at phenylalanine 353 of FAD-GDHa. In some embodiments, the mutation is located threonine 521 of FAD-GDHa. In some embodiments, the mutation is located phenylalanine 406 of FAD-GDHa. In some embodiments, FAD-GDHα has at least one mutation (e.g., 1 mutation, 2 mutations, 3 mutations, 4 mutations, 5 mutations, 6 mutations, 7 mutations, 8 mutations, 9 mutations, 10 mutations, 11 mutations, 12 mutations, 13 mutations, 14 mutations, 15 mutations, etc.). In some embodiments, FAD-GDHα has at least two mutations (e.g., 2 mutations, 3 mutations, 4 mutations, 5 mutations, 6 mutations, 7 mutations, 8 mutations, 9 mutations, 10 mutations, 11 mutations, 12 mutations, 13 mutations, 14 mutations, 15 mutations, etc.). In some embodiments, the mutations are point mutations. In some embodiments, asparagine 475 of FAD-GDHα is not mutated.

Artificially mutated FAD-GDHα protein is meant to refer to a FAD-GDHα protein which has at least one amino acid difference from a naturally-occurring FAD-GDHα protein. In some embodiments, the present invention is a protein, including: an artificially mutated FAD-GDHα protein including at least one mutation, where the at least one mutation (e.g., but not limited to, 1 mutation, 2 mutations, 3 mutations, 4 mutations, 5 mutations, 6 mutations, 7 mutations, 8 mutations, 9 mutations, 10 mutations, 11 mutations, 12 mutations, 13 mutations, 14 mutations, 15 mutations, etc.) is at position 406 of SEQ ID NO: 38 or SEQ ID NO: 39. In some embodiments, the at least one mutation is selected from the group including: F406S, F406C, F406T, F406M, F406V, F406Y, F406N, F406P, F406L, F406G, F406Q, F406A, F406I, F406D, F406W, F406H, and F406E. In some embodiments, the artificially mutated FAD-GDHα protein exhibits at least a 10% increase (e.g., but not limited to, 10%, 20%, 30%, 40%, 50%, 60%, 70%, 80%, 90%, 100%, etc.) in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 10%-400% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 10%-350% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 10%-300% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 10%-250% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 10%-200% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 10%-150% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 10%-100% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 10%-50% increase in biochemical activity compared to a FAD-GDHα wild-type protein comprising an amino acid sequence of SEQ ID NO: 38 or SEQ ID NO: 39.

In some embodiments, the artificially mutated FAD-GDHα protein exhibits between a 50%-400% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-400% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-400% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-400% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 250%-400% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 300%-400% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 350%-400% increase in biochemical activity compared to a FAD-GDHα wild-type protein comprising an amino acid sequence of SEQ ID NO: 38 or SEQ ID NO: 39.

In some embodiments, the artificially mutated FAD-GDHα protein exhibits between a 50%-350% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-300% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-250% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-250% increase in biochemical activity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-200% increase in biochemical activity compared to a FAD-GDHα wild-type protein comprising an amino acid sequence of SEQ ID NO: 38 or SEQ ID NO: 39.

In some embodiments, the artificially mutated FAD-GDHα protein exhibits at least a 40% increase (e.g., but not limited to, 40%, 50%, 60%, 70%, 80%, 90%, 100%, etc.) in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 40% and 400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 300% and 400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 350% and 400% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits between a 40% and 350% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 40% and 300% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 40% and 250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 40% and 200% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 40% and 150% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 40% and 100% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits between a 100% and 350% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 300% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 250% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 50% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 300% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 350% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 400% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 450% and 500% increase in linearity compared to a FAD-GDHα wild-type protein comprising an amino acid sequence of SEQ ID NO: 38 or SEQ ID NO: 39.

In some embodiments, the artificially mutated FAD-GDHα protein exhibits between a 20% and 450% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 400% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 350% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 300% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 250% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 200% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 150% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 100% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 50% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 50% and 450% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 400% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 350% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 300% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 250% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 300% increase in linearity compared to a FAD-GDHα wild-type protein comprising an amino acid sequence of SEQ ID NO: 38 or SEQ ID NO: 39.

The present invention is a protein, including: an artificially mutated FAD-GDHα protein including at least one mutation (e.g., but not limited to, 1 mutation, 2 mutations, 3 mutations, 4 mutations, 5 mutations, 6 mutations, 7 mutations, 8 mutations, 9 mutations, 10 mutations, 11 mutations, 12 mutations, 13 mutations, 14 mutations, 15 mutations, etc.), wherein the at least one mutation is at position 474 of SEQ ID NO: 1, or SEQ ID NO: 3. In some embodiments, the at least one mutation is selected from the group consisting of: N474H, N474L, N474S and N474V. In some embodiments, the artificially mutated FAD-GDHα protein exhibits at least a 20% increase (e.g., but not limited to, 20%, 30%, 40%, 50%, 60%, 70%, 80%, 90%, 100%, etc.) in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 50%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 250%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 300%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 350%-400% increase in activity compared to a FAD-GDHα wild-type protein comprising an amino acid sequence of SEQ ID NO: 38 or SEQ ID NO: 39.

In some embodiments, the artificially mutated FAD-GDHα protein exhibits between a 20%-350% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-300% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-250% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-200% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-100% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-50% increase in activity compared to a FAD-GDHα wild-type protein comprising an amino acid sequence of SEQ ID NO: 38 or SEQ ID NO: 39.

In some embodiments, the artificially mutated FAD-GDHα protein exhibits between a 50%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-350% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-300% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-250% increase in activity compared to a FAD-GDHα wild-type protein comprising an amino acid sequence of SEQ ID NO: 38 or SEQ ID NO: 39.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 50%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 250%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 300%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 350%-400% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits between a 20%-350% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-300% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-200% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-150% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-100% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-50% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits between a 50%-350% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-300% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-200% increase in selectivity compared to a FAD-GDHα wild-type protein comprising an amino acid sequence of SEQ ID NO: 38 or SEQ ID NO: 39.

The present invention is a protein, including: an artificially mutated FAD-GDHα protein including at least one mutation (e.g., but not limited to, 1 mutation, 2 mutations, 3 mutations, 4 mutations, 5 mutations, 6 mutations, 7 mutations, 8 mutations, 9 mutations, 10 mutations, 11 mutations, 12 mutations, 13 mutations, 14 mutations, 15 mutations, etc.), wherein the at least one mutation is at position 177 of SEQ ID NO: 1, or SEQ ID NO: 3. In some embodiments, the at least one mutation is N177S.

In some embodiments, the mutation is located at asparagine 177 of FAD-GDHα of *B. cepacia*. In some embodiments, the mutation is located at asparagine 177 of FAD-GDHα and the asparagine is mutated to a polar amino acid, e.g., but not limited to, serine, threonine, cysteine, tyrosine, arginine, and glutamine. In some embodiments, the mutation is located at asparagine 177 of FAD-GDHα and the asparagine is mutated to a polar amino acid, e.g., but not limited to, serine, threonine, and cysteine. In some embodiments, the mutation is located at asparagine 177 of FAD-GDHα and the asparagine is mutated to a polar amino acid, e.g., serine. In some embodiments, the mutation is located at asparagine 177 of FAD-GDHα and the asparagine is mutated to a basic amino acid, e.g., but not limited to, histidine and lysine. In some embodiments, the mutation is located at asparagine 177 of FAD-GDHα and the asparagine is mutated to an acidic amino acid, e.g., but not limited to, aspartic acid and glutamic acid. In some embodiments, the mutation is located at asparagine 177 of FAD-GDHα and the asparagine is mutated to a neutral amino acid, e.g., but not limited to, tryptophan, phenylalanine, glycine, alanine, valine, isoleucine, and leucine.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 50%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 250%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 300%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 350%-400% increase in activity compared to a FAD-GDHα wild-type protein comprising an amino acid sequence of SEQ ID NO: 38 or SEQ ID NO: 39.

In some embodiments, the artificially mutated FAD-GDHα protein exhibits between a 20%-350% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-300% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-250% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-200% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-100% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-50% increase in activity compared to a FAD-GDHα wild-type protein comprising an amino acid sequence of SEQ ID NO: 38 or SEQ ID NO: 39.

In some embodiments, the artificially mutated FAD-GDHα protein exhibits between a 50%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-350% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-300% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-250% increase in activity compared to a FAD-GDHα wild-type protein comprising an amino acid sequence of SEQ ID NO: 38 or SEQ ID NO: 39.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 50%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 250%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 300%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 350%-400% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits between a 20%-350% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-300% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-200% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-150% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-100% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-50% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits between a 50%-350% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-300% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-200% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 50% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 500% increase in linearity compared to a FAD-GDHα wild-type protein comprising an amino acid sequence of SEQ ID NO: 38 or SEQ ID NO: 39. In some embodiments, the artificially FAD-GDHα protein exhibits between a 200% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 300% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 350% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 400% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 450% and 500% increase in linearity compared to a FAD-GDHα wild-type protein comprising an amino acid sequence of SEQ ID NO: 38 or SEQ ID NO: 39.

In some embodiments, the artificially mutated FAD-GDHα protein exhibits between a 20% and 450% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 400% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 350% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 300% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 250% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 200% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 150% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 100% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 50% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 50% and 450% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 400% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 350% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 300% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 250% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 300% increase in linearity compared to a FAD-GDHα wild-type protein comprising an amino acid sequence of SEQ ID NO: 38 or SEQ ID NO: 39.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 50% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 500% increase in detectable current via direct electron transport compared to a FAD-GDHα wild-type protein comprising an amino acid sequence of SEQ ID NO: 38 or SEQ ID NO: 39. In some embodiments, the artificially FAD-GDHα protein exhibits between a 200% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 300% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 350% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 400% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 450% and 500% increase in detectable current via direct electron transport compared to a FAD-GDHα wild-type protein comprising an amino acid sequence of SEQ ID NO: 38 or SEQ ID NO: 39.

In some embodiments, the artificially mutated FAD-GDHα protein exhibits between a 20% and 450% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 400% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 350% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 300% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 250% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 200% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 150% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 100% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 50% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 50% and 450% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 400% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 350% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 300% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 250% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 300% increase in detectable current via direct electron transport compared to a FAD-GDHα wild-type protein comprising an amino acid sequence of SEQ ID NO: 38 or SEQ ID NO: 39.

The present invention is a protein, including: an artificially mutated FAD-GDHα protein including at least one mutation (e.g., but not limited to, 1 mutation, 2 mutations, 3 mutations, 4 mutations, 5 mutations, 6 mutations, 7 mutations, 8 mutations, 9 mutations, 10 mutations, 11 mutations, 12 mutations, 13 mutations, 14 mutations, 15 mutations, etc.), wherein the at least one mutation is at position 353 of SEQ ID NO: 1, or SEQ ID NO: 3. In some embodiments, the at least one mutation is F353L.

In some embodiments, the mutation is located at phenylalanine 353 of FAD-GDHα of *B. cepacia*. In some embodiments, the mutation is located at phenylalanine 353 of FAD-GDHα and the asparagine is mutated to a neutral amino acid, e.g., but not limited to, tryptophan, glycine, alanine, valine, isoleucine, and leucine. In some embodiments, the mutation is located at phenylalanine 353 of FAD-GDHα and the phenylalanine is mutated to a neutral amino acid, e.g., but not limited to, glycine, alanine, valine, isoleucine, and leucine. In some embodiments, the mutation is located at phenylalanine 353 of FAD-GDHα and the phenylalanine is mutated to a neutral amino acid, e.g., but not limited to, valine, isoleucine, and leucine. In some embodiments, the mutation is located at phenylalanine 353 of FAD-GDHα and the phenylalanine is mutated to a neutral amino acid, e.g., but not limited to, leucine. In some embodiments, the mutation is located at phenylalanine 353 of FAD-GDHα and the phenylalanine is mutated to a basic amino acid, e.g., but not limited to, histidine and lysine. In some embodiments, the mutation is located at phenylalanine 353 of FAD-GDHα and the phenylalanine is mutated to a polar amino acid, e.g., but not limited to, serine, threonine, cysteine, tyrosine, arginine, asparagine, and glutamine. In some embodiments, the mutation is located at phenylalanine 353 of FAD-GDHα and the phenylalanine is mutated to an acidic amino acid, e.g., but not limited to, aspartic acid and glutamic acid.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 50%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 250%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 300%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 350%-400% increase in activity compared to a FAD-GDHα wild-type protein comprising an amino acid sequence of SEQ ID NO: 38 or SEQ ID NO: 39.

In some embodiments, the artificially mutated FAD-GDHα protein exhibits between a 20%-350% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-300% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-250% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-200% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-100% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-50% increase in activity compared to a FAD-GDHα wild-type protein comprising an amino acid sequence of SEQ ID NO: 38 or SEQ ID NO: 39.

In some embodiments, the artificially mutated FAD-GDHα protein exhibits between a 50%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-350% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-300% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-250% increase in activity compared to a FAD-GDHα wild-type protein comprising an amino acid sequence of SEQ ID NO: 38 or SEQ ID NO: 39.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 50%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 250%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 300%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 350%-400% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits between a 20%-350% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-300% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-200% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-150% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-100% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-50% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits between a 50%-350% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-300% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-200% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 50% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 500% increase in linearity compared to a FAD-GDHα wild-type protein comprising an amino acid sequence of SEQ ID NO: 38 or SEQ ID NO: 39. In some embodiments, the artificially FAD-GDHα protein exhibits between a 200% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 300% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 350% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 400% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 450% and 500% increase in linearity compared to a FAD-GDHα wild-type protein comprising an amino acid sequence of SEQ ID NO: 38 or SEQ ID NO: 39.

In some embodiments, the artificially mutated FAD-GDHα protein exhibits between a 20% and 450% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 400% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 350% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 300% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 250% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 200% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 150% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 100% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 50% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 50% and 450% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 400% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 350% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 300% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 250% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 300% increase in linearity compared to a FAD-GDHα wild-type protein comprising an amino acid sequence of SEQ ID NO: 38 or SEQ ID NO: 39.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 50% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 500% increase in detectable current via direct electron transport compared to a FAD-GDHα wild-type protein comprising an amino acid sequence of SEQ ID NO: 38 or SEQ ID NO: 39. In some embodiments, the artificially FAD-GDHα protein exhibits between a 200% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 300% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 350% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 400% and 500% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 450% and 500% increase in detectable current via direct electron transport compared to a FAD-GDHα wild-type protein comprising an amino acid sequence of SEQ ID NO: 38 or SEQ ID NO: 39.

In some embodiments, the artificially mutated FAD-GDHα protein exhibits between a 20% and 450% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 400% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 350% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 300% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 250% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 200% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 150% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 100% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 50% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 50% and 450% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 400% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 350% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 300% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 250% increase in detectable current via direct electron transport compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 300% increase in detectable current via direct electron transport compared to a FAD-GDHα wild-type protein comprising an amino acid sequence of SEQ ID NO: 38 or SEQ ID NO: 39.

The present invention is a protein, including: an artificially mutated FAD-GDHα protein including at least one mutation (e.g., but not limited to, 1 mutation, 2 mutations, 3 mutations, 4 mutations, 5 mutations, 6 mutations, 7 mutations, 8 mutations, 9 mutations, 10 mutations, 11 mutations, 12 mutations, 13 mutations, 14 mutations, 15 mutations, etc.), wherein the at least one mutation is at position 215 of SEQ ID NO: 1, or SEQ ID NO: 3. In some embodiments, the at least one mutation is selected from the group consisting of: N215G, N215H, N215T, N215D, N215Y, and N215S.

In some embodiments, the mutation is located at asparagine 215 of FAD-GDHα of B. cepacia. In some embodiments, the mutation is located at asparagine 215 of FAD-GDHα and the asparagine is mutated to a polar amino acid, e.g., but not limited to, serine, threonine, cysteine, tyrosine, arginine, and glutamine. In some embodiments, the mutation is located at asparagine 215 of FAD-GDHα and the asparagine is mutated to a polar amino acid, e.g., but not limited to, serine, threonine, and cysteine. In some embodiments, the mutation is located at asparagine 215 of FAD-GDHα and the asparagine is mutated to a polar amino acid, e.g., serine. In some embodiments, the mutation is located at asparagine 215 of FAD-GDHα and the asparagine is mutated to a basic amino acid, e.g., but not limited to, histidine and lysine. In some embodiments, the mutation is located at asparagine 215 of FAD-GDHα and the asparagine is mutated to an acidic amino acid, e.g., but not limited to, aspartic acid and glutamic acid. In some embodiments, the mutation is located at asparagine 215 of FAD-GDHα and the asparagine is mutated to a neutral amino acid, e.g., but not limited to, tryptophan, phenylalanine, glycine, alanine, valine, isoleucine, and leucine.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 50%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 250%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 300%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 350%-400% increase in activity compared to a FAD-GDHα wild-type protein comprising an amino acid sequence of SEQ ID NO: 38 or SEQ ID NO: 39.

In some embodiments, the artificially mutated FAD-GDHα protein exhibits between a 20%-350% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-300% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-250% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-200% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-100% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-50% increase in activity compared to a FAD-GDHα wild-type protein comprising an amino acid sequence of SEQ ID NO: 38 or SEQ ID NO: 39.

In some embodiments, the artificially mutated FAD-GDHα protein exhibits between a 50%-400% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-350% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-

300% increase in activity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-250% increase in activity compared to a FAD-GDHα wild-type protein comprising an amino acid sequence of SEQ ID NO: 38 or SEQ ID NO: 39.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 50%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 250%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 300%-400% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 350%-400% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits between a 20%-350% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-300% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-200% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-150% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-100% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 20%-50% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits between a 50%-350% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 100%-300% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 200%-250% increase in selectivity compared to a FAD-GDHα wild-type protein comprising an amino acid sequence of SEQ ID NO: 38 or SEQ ID NO: 39. In some embodiments, the artificially mutated FAD-GDHα protein exhibits between a 150%-200% increase in selectivity compared to a FAD-GDHα wild-type protein comprising an amino acid sequence of SEQ ID NO: 38 or SEQ ID NO: 39.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 50% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 300% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 350% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 400% and 500% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 450% and 500% increase in linearity compared to a FAD-GDHα wild-type protein comprising an amino acid sequence of SEQ ID NO: 38 or SEQ ID NO: 39.

In some embodiments, the artificially mutated FAD-GDHα protein exhibits between a 20% and 450% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 400% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 350% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 300% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 250% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 200% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 150% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 100% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 20% and 50% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 50% and 450% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 100% and 400% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 150% and 350% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 300% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 200% and 250% increase in linearity compared to a FAD-GDHα wild-type protein comprising an amino acid sequence of SEQ ID NO: 38 or SEQ ID NO: 39. In some embodiments, the artificially mutated FAD-GDHα protein exhibits between a 250% and 300% increase in linearity compared to a FAD-GDHα wild-type protein comprising an amino acid sequence of SEQ ID NO: 38 or SEQ ID NO: 39.

In some embodiments, the artificially mutated FAD-GDHα protein exhibits at least a 20% increase (e.g., but not limited to, 20%, 30%, 40%, 50%, 60%, 70%, 80%, 90%, 100%, etc.) in current response compared to a FAD-GDHα wild-type protein comprising an amino acid sequence of SEQ ID NO: 38 or SEQ ID NO: 39. In some embodiments, the artificially mutated FAD-GDHα protein exhibits between a 20%-400% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 50%-400% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 100%-400% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 150%-400% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 200%-400% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 250%-400% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 300%-400% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 350%-400% increase in current response compared to a FAD-GDHα wild-type protein comprising an amino acid sequence of SEQ ID NO: 38 or SEQ ID NO: 39.

In some embodiments, the artificially mutated FAD-GDHα protein exhibits between a 20%-350% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 20%-300% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 20%-250% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 20%-200% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 20%-150% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 20%-100% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 20%-50% increase in current response compared to a FAD-GDHα wild-type protein comprising an amino acid sequence of SEQ ID NO: 38 or SEQ ID NO: 39.

In some embodiments, the artificially mutated FAD-GDHα protein exhibits between a 50%-350% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 100%-300% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 150%-250% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 200%-250% increase in current response compared to a FAD-GDHα wild-type protein comprising an amino acid sequence of SEQ ID NO: 38 or SEQ ID NO: 39. In some embodiments, the artificially mutated FAD-GDHα protein exhibits between a 150%-200% increase in current response compared to a FAD-GDHα wild-type protein comprising an amino acid sequence of SEQ ID NO: 38 or SEQ ID NO: 39.

In some embodiments, the at least one mutation is selected from the group including: F406S, F406C, F406T, F406M, F406V, F406Y, F406N, F406P, F406L, F406G, F406Q, F406A, F406I, F406D, F406W, F406H, and F406E results in at least a 20% increase (e.g., but not limited to, 20%, 30%, 40%, 50%, 60%, 70%, 80%, 90%, 100%, etc.) in linearity compared to a FAD-GDHα wild-type protein comprising an amino acid sequence of SEQ ID NO: 38 or SEQ ID NO: 39, but a decrease in the current response, compared to a FAD-GDHα wild-type protein comprising an amino acid sequence of SEQ ID NO: 38 or SEQ ID NO: 39.

In some embodiments, the at least one mutation is selected from the group consisting of: N215G, N215H, N215T, N215D, N215Y, and N215S results in at least a 20% increase (e.g., but not limited to, 20%, 30%, 40%, 50%, 60%, 70%, 80%, 90%, 100%, etc.) in current response compared to a FAD-GDHα wild-type protein comprising an amino acid sequence having at least one mutation is selected from the group including: F406S, F406C, F406T, F406M, F406V, F406Y, F406N, F406P, F406L, F406G, F406Q, F406A, F406I, F406D, F406W, F406H, and F406E.

In some embodiments, the protein of the present invention includes at least one mutation at position 406 of SEQ ID NO: 38 or SEQ ID NO: 39, where a phenylalanine at the position 406 of SEQ ID NO: 38 or SEQ ID NO: 39 is replaced with any amino acid other than K or R.

In some embodiments, a mutated FAD-GDHα protein, having at least one amino acid mutation, has at least 95% sequence identity (e.g., but not limited to, 95%, 96%, 97%, 98%, etc.) to SEQ ID NO: 38 or SEQ ID NO: 39. In some embodiments, a phenylalanine at the position 406 of SEQ ID NO: 38 or SEQ ID NO: 39 is replaced with any amino acid other than K or R.

In some embodiments, a mutated FAD-GDHα protein, having at least one amino acid mutation, has at least 96% sequence identity (e.g., but not limited to, 96%, 97%, 98%, etc.) to SEQ ID NO: 38 or SEQ ID NO: 39. In some embodiments, a phenylalanine at the position 406 of SEQ ID NO: 38 or SEQ ID NO: 39 is replaced with any amino acid other than K or R.

In some embodiments, a mutated FAD-GDHα protein, having at least one amino acid mutation, has at least 97% sequence identity (e.g., but not limited to, 97%, 97.5%, 98%, etc.) to SEQ ID NO: 38 or SEQ ID NO: 39. In some embodiments, a phenylalanine at the position 406 of SEQ ID NO: 38 or SEQ ID NO: 39 is replaced with any amino acid other than K or R.

In some embodiments, a mutated FAD-GDHα protein, having at least one amino acid mutation, has at least 98% sequence identity (e.g., but not limited to, 98%, 98.1%, 98.2%, etc.) to SEQ ID NO: 38 or SEQ ID NO: 39. In some embodiments, a phenylalanine at the position 406 of SEQ ID NO: 38 or SEQ ID NO: 39 is replaced with any amino acid other than K or R.

In some embodiments, a mutated FAD-GDHα protein, having at least one amino acid mutation, has at least 99% sequence identity (e.g., but not limited to, 99%, 99.1%, 99.2%, etc.) to SEQ ID NO: 38 or SEQ ID NO: 39. In some embodiments, a phenylalanine at the position 406 of SEQ ID NO: 38 or SEQ ID NO: 39 is replaced with any amino acid other than K or R.

In some embodiments, a mutated FAD-GDHα protein, having at least one amino acid mutation, has at least 95% sequence identity (e.g., but not limited to, 95%, 96%, 97%, 98%, etc.) to SEQ ID NO: 38 or SEQ ID NO: 39, where the asparagine residue at position 474 is substituted with valine, histidine, leucine, or serine.

In some embodiments, a mutated FAD-GDHα protein, having at least one amino acid mutation, has at least 96% sequence identity (e.g., but not limited to, 96%, 97%, 98%, etc.) to SEQ ID NO: 38 or SEQ ID NO: 39, where the asparagine residue at position 474 is substituted with valine, histidine, leucine, or serine.

In some embodiments, a mutated FAD-GDHα protein, having at least one amino acid mutation, has at least 97% sequence identity (e.g., but not limited to, 97%, 97.5%, 98%, etc.) to SEQ ID NO: 38 or SEQ ID NO: 39, where the asparagine residue at position 474 is substituted with valine, histidine, leucine, or serine.

In some embodiments, a mutated FAD-GDHα protein, having at least one amino acid mutation, has at least 98% sequence identity (e.g., but not limited to, 98%, 98.1%, 98.2%, etc.) to SEQ ID NO: 38 or SEQ ID NO: 39, where the asparagine residue at position 474 is substituted with valine, histidine, leucine, or serine.

In some embodiments, a mutated FAD-GDHα protein, having at least one amino acid mutation, has at least 99% sequence identity (e.g., but not limited to, 99%, 99.1%, 99.2%, etc.) to SEQ ID NO: 38 or SEQ ID NO: 39, where the asparagine residue at position 474 is substituted with valine, histidine, leucine, or serine.

In some embodiments, the present invention is a FAD-GDHα protein having at least 95% sequence identity to any of SEQ IDS: 9-29, 40-66, or 86-104. In some embodiments, the present invention is a FAD-GDHα protein having at least 96% sequence identity to any of SEQ IDS: 9-29, 40-66, or 86-104. In some embodiments, the present invention is a FAD-GDHα protein having at least 97% sequence identity to any of SEQ IDS: 9-29, 40-66, or 86-104. In some embodiments, the present invention is a FAD-GDHα protein having at least 98% sequence identity to any of SEQ IDS: 9-29, 40-66, or 86-104. In some embodiments, the present invention is a FAD-GDHα protein having at least 99% sequence identity to any of SEQ IDS: 9-29, 40-66, or 86-104.

In some embodiments, the present invention is a FAD-GDHα protein of any one of SEQ IDs: 9-29, 40-66, or 86-104 having between 1-5 amino acid mutations. In some embodiments, the present invention is a FAD-GDHα protein of any one of SEQ IDs: 9-29, 40-66, or 86-104 having between 1-10 amino acid mutations. In some embodiments, the present invention is a FAD-GDHα protein of any one of SEQ IDs: 9-29, 40-66, or 86-104 having between 1-15 amino acid mutations. Proteins of the instant invention are understood to comprise the full length of the amino acid sequence described in such SEQ ID NOs and not a subset.

In some embodiments, the present invention is a FAD-GDHα protein (SEQ ID NO: 38 or SEQ ID NO: 39) wherein the FAD-GDHα protein includes between 1-15 amino acid substitutions, where at least one amino acid substitution includes a substitution of the phenylalanine at position 406 to another other amino acid other than lysine or arginine.

In some embodiments, the present invention is a FAD-GDHα protein (SEQID:1) wherein the FAD-GDHα protein includes between 1-15 amino acid substitutions, where at least one amino acid substitution includes a substitution of the arginine at position 474 to a histidine, leucine, serine, or valine.

In some embodiments, the present invention is a method for measuring the glucose level of a subject, the method including: contacting a body fluid obtained from the subject with a mutant FAD-GDHα protein, measuring the current generated by the mutant FAD-GDHα protein, calculating the measured current to a glucose level, or any combination thereof. In some embodiments, the mutant FAD-GDHα protein includes between 1-15 amino acid substitutions including, e.g., but not limited to, a position of 406, 215, or 474 of SEQ ID NO: 38 or SEQ ID NO: 39.

Amino acids of the present invention include, but are not limited to the 20 commonly occurring amino acids. Also included are naturally occurring and synthetic derivatives, for example, selenocysteine. Amino acids further include amino acid analogs. An amino acid "analog" is a chemically related form of the amino acid having a different configuration, for example, an isomer, or a D-configuration rather than an L-configuration, or an organic molecule with the approximate size and shape of the amino acid, or an amino acid with modification to the atoms that are involved in the peptide bond, so as to be protease resistant when polymerized in a polypeptide.

The phrases "amino acid" and "amino acid sequence" as defined here and in the claims can include one or more components which are amino acid derivatives and/or amino acid analogs comprising part or the entirety of the residues for any one or more of the 20 naturally occurring amino acids indicated by that sequence. For example, in an amino acid sequence having one or more tyrosine residues, a portion of one or more of those residues can be substituted with homotyrosine.

The one letter and three letter amino acid codes (and the amino acid that each represents) are as follows: A means ala (alanine); C means cys (cysteine); D means asp (aspartic acid); E means glu (glutamic acid); F means phe (phenylalanine); G means gly (glycine); H means his (histidine); I means ile (isoleucine); K means lys (lysine); L means leu (leucine); M means met (methionine); N means asn (asparagine); P means pro (proline); Q means gln (glutamine); R means arg (arginine); S means ser (serine); T means thr (threonine); V means val (valine); W means trp (tryptophan); and Y means tyr (tyrosine).

Naturally occurring residues are divided into groups based on common side-chain properties: (1) hydrophobic: norleucine, met, ala, val, leu, ile; (2) neutral hydrophilic: cys, ser, thr; (3) acidic: asp, glu; (4) basic: asn, gln, his, lys, arg; (5) residues that influence chain orientation: gly, pro; (6) aromatic: trp, tyr, phe. A person skilled in the art would understand that certain conservative substitution may be made in the amino acid sequence of a protein. Conservative substitutions of interest are shown in Table 1.

TABLE 1

Exemplary and Preferred Amino acid substitutions.

| Original | Exemplary | Preferred |
|---|---|---|
| Ala (A) | val; leu; ile | val |
| Arg (R) | lys; gln; asn | lys |
| Asn (N) | gln; his; lys; arg | gln |
| Asp (D) | Glu | glu |
| Cys (C) | Ser | ser |
| Gln (Q) | Asn | asn |
| Glu (E) | Asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | Ala | ala |
| Ser (S) | Thr | thr |
| Thr (T) | Ser | ser |
| Trp (W) | tyr; phe | tyr |
| Tyr (Y) | trp; phe; thr; ser | phe |
| Val (V) | ile; leu; met; phe; ala; norleucine | leu |

In some embodiments, the composition of the present invention is directed to a FAD-GDHα including at least one point mutation attached to an enzyme electrode configured to: i) recognize a presence of a test subject (for example, glucose); ii) catalyze a redox reaction; and iii) transfer an electron generated from the redox reaction to the enzyme electrode. For purposes of the present invention, "catalyze" and "catalysis" refers to activity of specialized proteins (natural or recombinant), called enzymes, which lower the activation energy necessary for a reaction to occur.

In some embodiments, an enzyme electrode is constructed by immobilizing a FAD-GDHα alone or FAD-GDHα in complex with the gamma subunit on an electrode and/or an electrode layer. In some embodiments, a FAD-GDHα is immobilized by utilizing an immobilization method. In some embodiments of the present invention, the immobilization method is selected from the group consisting of: i) using a crosslinking reagent; ii) electropylimerization iii) entrapping an enzyme in a macromolecular matrix; iv) coating the enzyme with a dialysis membrane; and v) immobilizing the enzyme in a polymer, the polymer selected from the group consisting of: 1) a photo-crosslinking polymer; 2) an electric conductive polymer; and 3) a redox polymer. In some embodiments, combinations of the immobilization methods can be utilized.

In some embodiments, the present invention is directed to an enzyme electrode comprising a conductive material and an immobilized or wired FAD-GDHα. In some embodiments, the enzyme electrode generates a detectable electric current that corresponds to an amount of an analyte in a tested sample. In some embodiments, the enzyme electrode is an enzyme electrode including an immobilized enzyme on the surface of the enzyme electrode. In some embodiments of the present invention, the enzyme electrode is selected from the group consisting of a gold electrode, a platinum electrode, a carbon electrode, and any other conductive material that is suitable for constructing biosensors. In some embodiments of the present invention, the enzyme electrode utilizes a reaction specificity of an enzyme for detecting any of a variety of biologically active substances in a specific manner.

In some embodiments, the present invention is directed to a sensor including an enzyme electrode to function as a working electrode. In some embodiments of the present invention, the sensor is an assay system for electrochemically measuring a concentration of a test substance. In some embodiments of the present invention, the sensor includes three electrodes: i) a working electrode ii) a counter electrode; and iii) a reference electrode. In some embodiments of the present invention, the sensor comprises a two-electrode system comprising: i) a working electrode and ii) a counter electrode. In some embodiments, the sensor further includes a power source. In some embodiments, the power source applies voltage to: i) the working electrode; ii) an ampere meter; and iii) a recorder. In some embodiments, the sensor is a batch type sensor. In some embodiments, the sensor is a flow type sensor. In some embodiments, the sensor is a flow-type sensor, where the flow-type sensor continuously measures blood glucose level. In some embodiments, the two-electrode system comprising the immobilized enzyme is inserted into a flow of continuously supplied blood sample or dialyzed sample, or into a blood sample or an interstitial fluid sample. In some embodiments, the three-electrode system comprising the immobilized enzyme is inserted into a flow of continuously supplied blood sample or dialyzed sample, or into a blood sample or an interstitial fluid sample.

In some embodiments, the present invention also provides a glucose sensor comprising any of the FAD-GDHα proteins of the instant invention. Glucose sensors employing FAD-GDH are known in the art and have been described, for example, in U.S. Pat. No. 8,658,011, which is hereby incorporated by reference. The proteins of the instant invention may be employed in any biosensor know in the art that is designed to employ FAD-GDH.

In some embodiments, the present invention also provides a composition comprising the FAD-GDHα of the instant invention and a solid support. Such support may be in the form of a reagent layer or a reagent test strip. In some embodiments the composition is in a dry or solid state. Reagent layers for glucose sensors are known in the art, and have been described, for example, in U.S. Pat. No. 8,658,011. A person skilled in the art would understand that any reagent layer known in the art designed for use with FAD-GDH can be made to comprise the FAD-GDHα proteins of the instant invention. Reagent test strips are used in the determination of the concentration of an analyte, e.g. glucose, in a physiological sample, e.g. blood. The test strips can include a porous matrix, one or more members of an analyte oxidation signal producing system and at least one hemolyzing agent. In using the subject test strips for analyte concentration determination, a physiological sample is applied to the test strip. Next, the appearance of a chromogenic product of the signal producing system is detected and related to the concentration of the analyte in the sample.

Typically, a user inserts a test strip into a meter and lances a finger or alternate body site to obtain a blood sample. The drawn sample is applied to the test strip and the meter reads the strip and determines analyte concentration, which is then conveyed to the user. For example, the blood glucose meter converts a current generated by the enzymatic reaction in the test strip to a corresponding blood glucose value which is displayed or otherwise provided to the patient to show the level of glucose at the time of testing.

In some embodiments, the present invention also provides the FAD-GDHα proteins of the instant invention immobilized to the conductive component of an electrode of a glucose sensor. Electrodes for glucose sensors are known in the art, and have been described, for example, in U.S. Pat. No. 7,497,940, the contents of which are hereby incorporated by reference. A person skilled in the art would understand that any electrode known in the art designed for use with FAD-GDH can be made to comprise the FAD-GDHα proteins of the instant invention.

In some embodiments, the present invention provides an enzyme electrode, configured to measure the amount of glucose in a physiological fluid, comprising the mutated FAD-GDHα protein according to some embodiments of the present invention immobilized onto the electrode, wherein the mutated FAD-GDHα protein according to some embodiments of the present invention is configured to catalyze glucose in the physiological fluid and produce electrons that are transferred to the electrode thereby generating an electrical current, wherein the intensity of the electrical current is indicative of the level of glucose in the physiological fluid.

As used herein, the term "physiological fluid" refers to blood, saliva, interstitial fluid, cell culture medium, and the like.

In some embodiments, the enzyme electrode is a screen printed electrode

In some embodiments, the enzyme electrode is configured to perform a single measurement.

An example of an enzyme electrode into which a mutated enzyme according to some embodiments of the present invention may be incorporated is disclosed in U.S. Pat. No. 4,431,507.

Another example of an enzyme electrode into which a mutated enzyme according to some embodiments of the present invention may be incorporated is disclosed in U.S. Pat. No. 5,762,770.

Another example of an enzyme electrode into which a mutated enzyme according to some embodiments of the present invention may be incorporated is disclosed in U.S. Pat. No. 6,270,637.

In some embodiments, the enzyme electrode is incorporated into a glucose test strip.

In some embodiments, the mutated FAD-GDHα protein is immobilized on the electrode in a conductive matrix.

In some embodiments, the conductive matrix is selected from a group consisting of carbon paste, graphite paste, graphene oxide, or any other conductive matrix paste appropriate for use in screen printed electrodes.

In some embodiments, the conductive matrix is a conductive polymer.

In some embodiments, the conductive polymer is selected from the group consisting of: PEDOT, and Polypyrrol.

In some embodiments, the conductive polymer is electropolymerized on the electrode together with the mutated FAD-GDHα protein.

In some embodiments, the conductive polymer is chemically polymerized on the electrode together with the mutated FAD-GDHα protein.

In some embodiments, the mutated FAD-GDHα protein of the present invention is immobilized to the electrode by chemical wiring.

In some embodiments, the conductive matrix further comprises an electron mediator.

In one embodiment, the enzyme electrode, configured to measure the amount of glucose in a physiological fluid, comprising the mutated FAD-GDHα protein according to some embodiments of the present invention immobilized onto the electrode further comprises at least one subunit selected from the group consisting of: wild-type FAD-GDHβ subunit, and a wild-type FAD-GDHγ subunit.

In some embodiments, the enzyme electrode of the present invention is incorporated into a biosensor configured for subcutaneous continuous glucose measurement, wherein the biosensor is configured to continually measure the amount of glucose in the subject.

In some embodiments, the biosensor is configured to continuously measure glucose for up to 2 weeks. In some embodiments, the biosensor is configured to continuously measure glucose for up to one week. In some embodiments, the biosensor is configured to continuously measure glucose for up to six days. In some embodiments, the biosensor is configured to continuously measure glucose for up to five days. In some embodiments, the biosensor is configured to continuously measure glucose for up to four days. In some embodiments, the biosensor is configured to continuously measure glucose for up to three days. In some embodiments, the biosensor is configured to continuously measure glucose for up to two days. In some embodiments, the biosensor is configured to continuously measure glucose for up to one day.

In some embodiments, the biosensor is configured to continuously measure glucose for up to 64 hours. In some embodiments, the biosensor is configured to continuously measure glucose for up to 62 hours. In some embodiments, the biosensor is configured to continuously measure glucose for up to 60 hours. In some embodiments, the biosensor is configured to continuously measure glucose for up to 58 hours. In some embodiments, the biosensor is configured to continuously measure glucose for up to 56 hours. In some embodiments, the biosensor is configured to continuously measure glucose for up to 54 hours. In some embodiments, the biosensor is configured to continuously measure glucose for up to 52 hours. In some embodiments, the biosensor is configured to continuously measure glucose for up to 50 hours. In some embodiments, the biosensor is configured to continuously measure glucose for up to 48 hours. In some embodiments, the biosensor is configured to continuously measure glucose for up to 46 hours. In some embodiments, the biosensor is configured to continuously measure glucose for up to 44 hours. In some embodiments, the biosensor is configured to continuously measure glucose for up to 42 hours. In some embodiments, the biosensor is configured to continuously measure glucose for up to 40 hours. In some embodiments, the biosensor is configured to continuously measure glucose for up to 38 hours. In some embodiments, the biosensor is configured to continuously measure glucose for up to 36 hours. In some embodiments, the biosensor is configured to continuously measure glucose for up to 34 hours. In some embodiments, the biosensor is configured to continuously measure glucose for up to 32 hours. In some embodiments, the biosensor is configured to continuously measure glucose for up to 30 hours. In some embodiments, the biosensor is configured to continuously measure glucose for up to 28 hours. In some embodiments, the biosensor is configured to continuously measure glucose for up to 26 hours. In some embodiments, the biosensor is configured to continuously measure glucose for up to 24 hours. In some embodiments, the biosensor is configured to continuously measure glucose for up to 20 hours. In some embodiments, the biosensor is configured to continuously measure glucose for up to 18 hours. In some embodiments, the biosensor is configured to continuously measure glucose for up to 16 hours. In some embodiments, the biosensor is configured to continuously measure glucose for up to 14 hours. In some embodiments, the biosensor is configured to continuously measure glucose for up to 12 hours. In some embodiments, the biosensor is configured to continuously measure glucose for up to 10 hours. In some embodiments, the biosensor is configured to continuously measure glucose for up to 8 hours. In some embodiments, the biosensor is configured to continuously measure glucose for up to 6 hours. In some embodiments, the biosensor is configured to continuously measure glucose for up to 4 hours. In some embodiments, the biosensor is configured to continuously measure glucose for up to 2 hours. In some embodiments, the biosensor is configured to continuously measure glucose for up to 1 hour.

An example of a biosensor into which a mutated enzyme according to some embodiments of the present invention may be incorporated is disclosed in U.S. Pat. No. 9,163,273.

Another example of a biosensor into which a mutated enzyme according to some embodiments of the present invention may be incorporated is disclosed in U.S. Pat. No. 8,808,532.

Another example of a biosensor into which a mutated enzyme according to some embodiments of the present invention may be incorporated is disclosed in U.S. Pat. No. 7,074,307.

In some embodiments, the biosensor comprises the mutated FAD-GDHα protein according to some embodiments of the present invention immobilized onto at least one enzyme electrode, wherein the mutated FAD-GDHα protein according to some embodiments of the present invention is configured to catalyze glucose in the subject and generate electrons that are transferred to the electrode and generate electrical current, wherein the intensity of the electrical current is indicative of the level of glucose in the subject.

In some embodiments, the mutated FAD-GDHα protein that is configured to catalyze glucose in the subject and generate electrons that are transferred to the electrode and generate electrical current comprises: $P(X)_{n=8}X^4(X)_{n=6}$ $V(X)_{n=6}RN(X)_{n=3}YDXRPXCXGX^3NNCMP(X)_{n=1}CP$ $(X)_{n=2}A(X)_{n=1}Y(X)_{n=1}G(X)_{n=6}A(X)_{n=2}AG(X)_{n=6}AVV$ $(X)_{n=3}E(X)_{n=8-9}A(X)_{n=2}Y(X)_{n=1}D(X)_{n=5}HRV(X)_{n=5}$ $V(X)_{n=2}A(X)_{n=3}E(X)_{n=2}K(X)_{n=4}S(X)_{n=5}P(X)_{n=1}G(X)_{n=2}N$ $(X)_{n=4}GRN(X)_{n=1}MDH(X)_{n=4}V(X)_{n=1}F(X)_{n=6-7}W(X)_{n=1}$ $GRGP(X)_{n=9}RDGXX^5R(X)_{n=19}T(X)_{n=14}L(X)_{n=14}X^2(X)_{n=1}$ $X^1(X)_{n=1}E(X)_{n=4}P(X)_{n=1}NR(X)_{n=3}S(X)_{n=4}D(X)_{n=2}G(X)_{n=7}$ $Y(X)_{n=4}Y(X)_{n=32-35}$, wherein each X represents a wild-type amino acid residue of the first species and n indicates the number of the wild-type amino acid residues of the first species represented by a respective parenthetical at that position, wherein:

a) $X^1$ is selected from the group consisting of X, S, C, T, M, V, Y, N, P, L, G, Q, A, I, D, W, H, and E, wherein if $X^1$ is L, H or V, then $X^2$ is D;
  b) $X^3$ is selected from the group consisting of G, H, D, Y, S, and X;
  c) $X^4$ is selected from the group consisting of S and X; and
  d) $X^5$ is selected from the group consisting of L and X.

In some embodiments, the mutated FAD-GDHα protein further comprises at least one subunit selected from the group consisting of: wild-type FAD-GDHβ subunit, and a wild-type FAD-GDHγ subunit.

In some embodiments, the mutated FAD-GDHα protein that is configured to catalyze glucose in the subject and generate electrons that are transferred to the electrode and generate electrical current comprises: $P(X)_{n=8}X^4(X)_{n=16}V(X)_{n=6}RN(X)_{n=3}YDXRPXCXGX^3NNCMP(X)_{n=1}CP(X)_{n=2}A(X)_{n=1}Y(X)_{n=1}G(X)_{n=6}A(X)_{n=2}AG(X)_{n=6}AVV(X)_{n=3}E(X)_{n=8-9}A(X)_{n=2}Y(X)_{n=1}D(X)_{n=5}HRV(X)_{n=5}V(X)_{n=2}A(X)_{n=3}E(X)_{n=2}K(X)_{n=4}S(X)_{n=5}P(X)_{n=1}G(X)_{n=2}N(X)_{n=4}GRN(X)_{n=1}MDH(X)_{n=4}V(X)_{n=1}F(X)_{n=6-7}W(X)_{n=1}GRGP(X)_{n=9}RDGXX^5R(X)_{n=19}T(X)_{n=14}L(X)_{n=14}X^2(X)_{n=1}X^1(X)_{n=1}E(X)_{n=4}P(X)_{n=1}NR(X)_{n=3}S(X)_{n=4}D(X)_{n=2}G(X)_{n=7}Y(X)_{n=4}Y(X)_{n=32-35}$, wherein each X represents a wild-type amino acid residue of the first species and n indicates the number of the wild-type amino acid residues of the first species represented by a respective parenthetical at that position, wherein:

a) $X^1$ is selected from the group consisting of S, C, T, M, V, Y, N, P, L, G, Q, A, I, D, W, H, and E, wherein if $X^1$ is L, H or V, then $X^2$ is D;
b) $X^3$ is selected from the group consisting of G, H, D, Y, S, and X;
c) $X^4$ is selected from the group consisting of S and X; and
d) $X^5$ is selected from the group consisting of L and X.

In some embodiments, the mutated FAD-GDHα protein further comprises at least one subunit selected from the group consisting of: wild-type FAD-GDHPβ subunit, and a wild-type FAD-GDHγ subunit.

In some embodiments, the mutated FAD-GDHα protein that is configured to catalyze glucose in the subject and generate electrons that are transferred to the electrode and generate electrical current comprises: $P(X)_{n=8}X^4(X)_{n=16}V(X)_{n=6}RN(X)_{n=3}YDXRPXCXGX^3NNCMP(X)_{n=1}CP(X)_{n=2}A(X)_{n=1}Y(X)_{n=1}G(X)_{n=6}A(X)_{n=2}AG(X)_{n=6}AVV(X)_{n=3}E(X)_{n=8-9}A(X)_{n=2}Y(X)_{n=1}D(X)_{n=5}HRV(X)_{n=5}V(X)_{n=2}A(X)_{n=3}E(X)_{n=2}K(X)_{n=4}S(X)_{n=5}P(X)_{n=1}G(X)_{n=2}N(X)_{n=4}GRN(X)_{n=1}MDH(X)_{n=4}V(X)_{n=1}F(X)_{n=6-7}W(X)_{n=1}GRGP(X)_{n=9}RDGXX^5R(X)_{n=19}T(X)_{n=14}L(X)_{n=14}X^2(X)_{n=1}X^1(X)_{n=1}E(X)_{n=4}P(X)_{n=1}NR(X)_{n=3}S(X)_{n=4}D(X)_{n=2}G(X)_{n=7}Y(X)_{n=4}Y(X)_{n=32-35}$, wherein each X represents a wild-type amino acid residue of the first species and n indicates the number of the wild-type amino acid residues of the first species represented by a respective parenthetical at that position, wherein:

a) $X^1$ is selected from the group consisting of S, C, T, M, V, Y, N, P, L, G, Q, A, I, D, W, H, and E, wherein if $X^1$ is L, H or V, then $X^2$ is D;
b) $X^3$ is selected from the group consisting of G, H, D, Y, S, and X;
c) $X^4$ is X; and
d) $X^5$ is X.

In some embodiments, the mutated FAD-GDHα protein further comprises at least one subunit selected from the group consisting of: wild-type FAD-GDHβ subunit, and a wild-type FAD-GDHγ subunit.

In some embodiments, the mutated FAD-GDHα protein that is configured to catalyze glucose in the subject and generate electrons that are transferred to the electrode and generate electrical current comprises: $P(X)_{n=8}X^4(X)_{n=16}V(X)_{n=6}RN(X)_{n=3}YDXRPXCXGX^3NNCMP(X)_{n=1}CP(X)_{n=2}A(X)_{n=1}Y(X)_{n=1}G(X)_{n=6}A(X)_{n=2}AG(X)_{n=6}AVV(X)_{n=3}E(X)_{n=8-9}A(X)_{n=2}Y(X)_{n=1}D(X)_{n=5}HRV(X)_{n=5}V(X)_{n=2}A(X)_{n=3}E(X)_{n=2}K(X)_{n=4}S(X)_{n=5}P(X)_{n=1}G(X)_{n=2}N(X)_{n=4}GRN(X)_{n=1}MDH(X)_{n=4}V(X)_{n=1}F(X)_{n=6-7}W(X)_{n=1}GRGP(X)_{n=9}RDGXX^5R(X)_{n=19}T(X)_{n=14}L(X)_{n=14}X^2(X)_{n=1}X^1(X)_{n=1}E(X)_{n=4}P(X)_{n=1}NR(X)_{n=3}S(X)_{n=4}D(X)_{n=2}G(X)_{n=7}Y(X)_{n=4}Y(X)_{n=32-35}$, wherein each X represents a wild-type amino acid residue of the first species and n indicates the number of the wild-type amino acid residues of the first species represented by a respective parenthetical at that position, wherein:

a) $X^1$ is selected from the group consisting of S, C, T, M, V, Y, N, P, L, G, Q, A, I, D, W, H, and E, wherein if $X^1$ is L, H or V, then $X^2$ is D;
b) $X^3$ is X;
c) $X^4$ is X; and
d) $X^5$ is X.

In some embodiments, the mutated FAD-GDHα protein further comprises at least one subunit selected from the group consisting of: wild-type FAD-GDHβ subunit, and a wild-type FAD-GDHγ subunit.

In some embodiments, the mutated FAD-GDHα protein that is configured to catalyze glucose in the subject and generate electrons that are transferred to the electrode and generate electrical current comprises: $P(X)_{n=8}X^4(X)_{n=16}V(X)_{n=6}RN(X)_{n=3}YDXRPXCXGX^3NNCMP(X)_{n=1}CP(X)_{n=2}A(X)_{n=1}Y(X)_{n=1}G(X)_{n=6}A(X)_{n=2}AG(X)_{n=6}AVV(X)_{n=3}E(X)_{n=8-9}A(X)_{n=2}Y(X)_{n=1}D(X)_{n=5}HRV(X)_{n=5}V(X)_{n=2}A(X)_{n=3}E(X)_{n=2}K(X)_{n=4}S(X)_{n=5}P(X)_{n=1}G(X)_{n=2}N(X)_{n=4}GRN(X)_{n=1}MDH(X)_{n=4}V(X)_{n=1}F(X)_{n=6-7}W(X)_{n=1}GRGP(X)_{n=9}RDGXX^5R(X)_{n=19}T(X)_{n=14}L(X)_{n=14}X^2(X)_{n=1}X^1(X)_{n=1}E(X)_{n=4}P(X)_{n=1}NR(X)_{n=3}S(X)_{n=4}D(X)_{n=2}G(X)_{n=7}Y(X)_{n=4}Y(X)_{n=32-35}$, wherein each X represents a wild-type amino acid residue of the first species and n indicates the number of the wild-type amino acid residues of the first species represented by a respective parenthetical at that position, wherein:

a) $X^1$ is X;
b) $X^3$ is selected from the group consisting of G, H, D, Y, S, and X;
c) $X^4$ is X; and
d) $X^5$ is X.

In some embodiments, the mutated FAD-GDHα protein further comprises at least one subunit selected from the group consisting of: wild-type FAD-GDHβ subunit, and a wild-type FAD-GDHγ subunit.

In some embodiments, the mutated FAD-GDHα protein that is configured to catalyze glucose in the subject and generate electrons that are transferred to the electrode and generate electrical current comprises: $P(X)_{n=8}X^4(X)_{n=16}V(X)_{n=6}RN(X)_{n=3}YDXRPXCXGX^3NNCMP(X)_{n=1}CP(X)_{n=2}A(X)_{n=1}Y(X)_{n=1}G(X)_{n=6}A(X)_{n=2}AG(X)_{n=6}AVV(X)_{n=3}E(X)_{n=8-9}A(X)_{n=2}Y(X)_{n=1}D(X)_{n=5}HRV(X)_{n=5}V(X)_{n=2}A(X)_{n=3}E(X)_{n=2}K(X)_{n=4}S(X)_{n=5}P(X)_{n=1}G(X)_{n=2}N(X)_{n=4}GRN(X)_{n=1}MDH(X)_{n=4}V(X)_{n=1}F(X)_{n=6-7}W(X)_{n=1}GRGP(X)_{n=9}RDGXX^5R(X)_{n=19}T(X)_{n=14}L(X)_{n=14}X^2(X)_{n=1}X^1(X)_{n=1}E(X)_{n=4}P(X)_{n=1}NR(X)_{n=3}S(X)_{n=4}D(X)_{n=2}G(X)_{n=7}Y(X)_{n=4}Y(X)_{n=32-35}$, wherein each X represents a wild-type amino acid residue of the first species and n indicates the number of the wild-type amino acid residues of the first species represented by a respective parenthetical at that position, wherein:

a) $X^1$ is selected from the group consisting of S, C, T, M, V, Y, N, P, L, G, Q, A, I, D, W, H, and E, wherein if $X^1$ is L, H or V, then $X^2$ is D;
b) $X^3$ is selected from the group consisting of G, H, D, Y, and S;
c) $X^4$ is S; and
d) $X^5$ is X.

In some embodiments, the mutated FAD-GDHα protein further comprises at least one subunit selected from the group consisting of: wild-type FAD-GDHβ subunit, and a wild-type FAD-GDHγ subunit.

In some embodiments, the mutated FAD-GDHα protein that is configured to catalyze glucose in the subject and generate electrons that are transferred to the electrode and generate electrical current comprises: $P(X)_{n=8}X^4(X)_{n=16}V(X)_{n=6}RN(X)_{n=3}YDXRPXCXGX^3NNCMP(X)_{n=1}CP(X)_{n=2}A(X)_{n=1}Y(X)_{n=1}G(X)_{n=6}A(X)_{n=2}AG(X)_{n=6}AVV(X)_{n=3}E(X)_{n=8-9}A(X)_{n=2}Y(X)_{n=1}D(X)_{n=5}HRV(X)_{n=5}V(X)_{n=2}A(X)_{n=3}E(X)_{n=2}K(X)_{n=4}$ $S(X)_{n=5}P(X)_{n=1}G(X)_{n=2}N(X)_{n=4}GRN(X)_{n=1}MDH(X)_{n=4}V(X)_{n=1}F(X)_{n=6-7}W(X)_{n=1}GRGP(X)_{n=9}RDGXX^5R(X)_{n=19}T(X)_{n=14}L(X)_{n=14}X^2(X)_{n=1}X^1(X)_{n=1}E(X)_{n=4}P(X)_{n=1}NR(X)_{n=3}S(X)_{n=4}D(X)_{n=2}G(X)_{n=7}Y(X)_{n=4}Y(X)_{n=32-35}$, wherein each X represents a wild-type amino acid residue of the first species and n indicates the number of the wild-type amino acid residues of the first species represented by a respective parenthetical at that position, wherein:

a) $X^1$ is selected from the group consisting of S, C, T, M, V, Y, N, P, L, G, Q, A, I, D, W, H, and E, wherein if $X^1$ is L, H or V, then $X^2$ is D;
b) $X^3$ is selected from the group consisting of G, H, D, Y, and S;
c) $X^4$ is X; and
d) $X^5$ is L.

In some embodiments, the mutated FAD-GDHα protein further comprises at least one subunit selected from the group consisting of: wild-type FAD-GDHβ subunit, and a wild-type FAD-GDHγ subunit.

In some embodiments, the mutated FAD-GDHα protein that is configured to catalyze glucose in the subject and generate electrons that are transferred to the electrode and generate electrical current comprises: $P(X)_{n=8}X^4(X)_{n=16}V(X)_{n=6}RN(X)_{n=3}YDXRPXCXGX^3NNCMP(X)_{n=1}CP(X)_{n=2}A(X)_{n=1}Y(X)_{n=1}G(X)_{n=6}A(X)_{n=2}AG(X)_{n=6}AVV(X)_{n=3}E(X)_{n=8-9}A(X)_{n=2}Y(X)_{n=1}D(X)_{n=5}HRV(X)_{n=5}V(X)_{n=2}A(X)_{n=3}E(X)_{n=2}K(X)_{n=4}S(X)_{n=5}P(X)_{n=1}G(X)_{n=2}N(X)_{n=4}GRN(X)_{n=1}MDH(X)_{n=4}V(X)_{n=1}F(X)_{n=6-7}W(X)_{n=1}GRGP(X)_{n=9}RDGXX^5R(X)_{n=19}T(X)_{n=14}L(X)_{n=14}X^2(X)_{n=1}X^1(X)_{n=1}E(X)_{n=4}P(X)_{n=1}NR(X)_{n=3}S(X)_{n=4}D(X)_{n=2}G(X)_{n=7}Y(X)_{n=4}Y(X)_{n=32-35}$, wherein each X represents a wild-type amino acid residue of the first species and n indicates the number of the wild-type amino acid residues of the first species represented by a respective parenthetical at that position, wherein:

a) $X^1$ is selected from the group consisting of S, C, T, M, V, Y, N, P, L, G, Q, A, I, D, W, H, or E, wherein if $X^1$ is L, H or V, then $X^2$ is D;
b) $X^3$ is X;
c) $X^4$ is S; and
d) $X^5$ is L.

In some embodiments, the mutated FAD-GDHα protein further comprises at least one subunit selected from the group consisting of: wild-type FAD-GDHβ subunit, and a wild-type FAD-GDHγ subunit.

In some embodiments, the mutated FAD-GDHα protein that is configured to catalyze glucose in the subject and generate electrons that are transferred to the electrode and generate electrical current comprises: $P(X)_{n=8}X^4(X)_{n=16}V(X)_{n=6}RN(X)_{n=3}YDXRPXCXGX^3NNCMP(X)_{n=1}CP(X)_{n=2}A(X)_{n=1}Y(X)_{n=1}G(X)_{n=6}A(X)_{n=2}AG(X)_{n=6}AVV(X)_{n=3}E(X)_{n=8-9}A(X)_{n=2}Y(X)_{n=1}D(X)_{n=5}HRV(X)_{n=5}V(X)_{n=2}A(X)_{n=3}E(X)_{n=2}K(X)_{n=4}S(X)_{n=5}P(X)_{n=1}G(X)_{n=2}N(X)_{n=4}GRN(X)_{n=1}MDH(X)_{n=4}V(X)_{n=1}F(X)_{n=6-7}W(X)_{n=1}GRGP(X)_{n=9}RDGXX^5R(X)_{n=19}T(X)_{n=14}L(X)_{n=14}X^2(X)_{n=1}X^1(X)_{n=1}E(X)_{n=4}P(X)_{n=1}NR(X)_{n=3}S(X)_{n=4}D(X)_{n=2}G(X)_{n=7}Y(X)_{n=4}Y(X)_{n=32-35}$, wherein each X represents a wild-type amino acid residue of the first species and n indicates the number of the wild-type amino acid residues of the first species represented by a respective parenthetical at that position, wherein:

a) $X^1$ is selected from the group consisting of S, C, T, M, V, Y, N, P, L, G, Q, A, I, D, W, H, or E, wherein if $X^1$ is L, H or V, then $X^2$ is D;
b) $X^3$ is selected from the group consisting of G, H, D, Y, and S;
c) $X^4$ is S; and
d) $X^5$ is L.

In some embodiments, the mutated FAD-GDHα protein further comprises at least one subunit selected from the group consisting of: wild-type FAD-GDHβ subunit, and a wild-type FAD-GDHγ subunit.

In some embodiments, the mutated FAD-GDHα protein that is configured to catalyze glucose in the subject and generate electrons that are transferred to the electrode and generate electrical current comprises a mutated FAD-GDHα having an amino acid sequence set forth in any one of SEQ ID NOS: 9-29, SEQ ID NOS: 46-104, or SEQ ID NOS: 105-129.

In some embodiments, the electrode is made from a material selected from the group consisting of: carbon fiber, graphite, glassy carbon, gold, silver, copper, platinum, palladium, and metal oxide.

In some embodiments, the metal oxide is indium tin oxide.

In some embodiments, mutant FAD-GDHα, according to some embodiments of the present invention is immobilized to a carbon electrode via an electropolymerization method. Briefly, the 3-array screen printed electrodes ("SPE"), which contain working, counter and reference electrodes, is overlaid with 60 μl of saturated $HKCO_3$ solution and voltage applied immediately at 1.2V for 180 seconds (versus Ag/AgCl). The solution is then discarded and washed three times with 60 μl of PBS 7.4 supplemented with 0.01M magnesium chloride ("EC buffer"). The SPE is then overlaid with 60 μl of immobilization solution containing of 0.1M pyrrole, 0.1M potassium chloride and 1 mg/ml of SZ2 enzyme. Alternatively, the SPE waiss then overlaid with 60 μl of immobilization solution containing of 0.01M PEDOT, 0.7% poly styrene sulfonate (70K Mw) and 1 mg/ml of SZ2 enzyme. An external electron mediator ("mediator") can be added to the immobilization solution at the range of 0.5-10 mM. As used herein, "electron mediator" or "mediator" refers to a chemical that transfers electrons from the enzyme (e.g., but not limited to, FAD-GDH) to an anode. Electron mediators can include, but are not limited to, Quinone/Hydroquinone, Phenanthroline quinone, Quinone diimine/Phenylendiamine, Qunone diimine oxides (Nitrosoanilines), *Phenazinium*/-radical/Dihydro-phenazine, N-oxides (Resazurin, Bezfuroxan), Hexacyanoferrate III/III, Ferricinium/Ferrocene (carboxylic acid), Ruthenium complexes, Osmium as complexed and/or immobilized state and any other mediators common in the art. The solution was incubated at room temperature (RT) for 1 minute prior to applying a set of 10 pulses at 0.65V for 1 second with 5 second relaxation. The solution was then discarded and washed three times with 60 μl of EC buffer for initiation of glucose sensing measurement phase.

In the embodiments utilizing PEDOT, the solution is incubated at room temperature (RT) for 1 minute prior to applying 2 cyclic voltammetry cycles (0.2-0.9V 50 mv/sec).

In some embodiments, the electrode is overlaid with immobilization solution devoid of any mediator as indicated in the table below. These embodiments enable direct electron transfer ("DET"). In some embodiments, the immobilization solution is electropolymerized onto the electrode as described in the table below. The solution is then discarded and washed three times with 60 μl of EC buffer for initiation of glucose sensing measurements phase as detailed in the table below. The electrochemical data was collected using a VMP3 multi-channel potentiostat (Bio-logic Science instruments SAS, France).

| # | Composition description | Polymerization method | Glucose sensing |
|---|---|---|---|
| 1 | 0.25M pyrrole, 0.25M potassium chloride, Phosphate Buffer Saline pH 7.4 supplemented with 0.01 mM MgCl$_2$ and 0.1% Proclin 150 (Sigma, cat# 49376-u) ("PBSm") and 0.33 mg/ml of Mut111 enzyme | 20 CA pulses of 0.65 V, 1 second each with 5 second intervals between each pulse | 0.2 V for 30 minutes |
| 2 | 0.01M 3,4-Ethylenedioxythiophene ("EDOT"), 0.1 mM Ply(sodium 4-styrenesulfonate) ("PSS"), PBSm and 1 mg/ml of Mut111 enzyme | CV cycles ranging 0.2-0.85 V with a scanning speed of 0.05 V/Sec | 0.3 V for 30 minutes |

Examples of methods by which mutated enzyme according to some embodiments of the present invention may be incorporated into a biosensor are disclosed in U.S. Pat. No. 9,163,273.

Other examples of methods by which mutated enzyme according to some embodiments of the present invention may be incorporated into a biosensor are disclosed in U.S. Pat. No. 8,808,532.

Although the following exemplary embodiments were conducted with non-naturally mutated FAD-GDHα derived from *B. cepacia*, these exemplary embodiments are non-limiting and can be extended to related bacterial FAD-GDHα, such as, but not limited to, FAD-GDHα derived from *B. lata, Burkholderia terrae, Pseudomonas denitrificans, Relsonia pickettii, Yersinia mollretii, Pandoraea* sp. and *Herbspirilum sropedicae*. FIG. 7 illustrates the homology of the following species: *B. cepacia, H. Seropedicae, B. terrae, P. Dentrificans, Y. mollaretii, R. Pickettii,* and *Pandoraea*. The positions described herein are noted using ellipsoid shapes on FIG. 31.

The following electrochemical exemplary embodiments use conductive polymers, e.g., polypyrrole. In some embodiments, a conductive polymer is used to generate electrochemical data and includes polypyrrole, polythiophene (e.g., poly(3,4-ethylenedioxythiophene)—"PEDOT"), polyaniline, poly(diphenylamine), polyazine, poly(o-aminophenol, or any combination thereof.

In some embodiments, the present invention also provides a DNA sequence encoding any of the proteins of the instant invention. Such DNA sequence may be expressed according to any technique known in the art. By way of non-limiting example, such sequence may be incorporated into a vector for expression in a cell. The term "vector" refers to a polynucleotide molecule capable of carrying and transferring another polynucleotide fragment or sequence to which it has been linked from one location (e.g., a host, a system) to another. The term includes vectors for in vivo or in vitro expression systems. As a non-limiting example, vectors can be in the form of "plasmids" which refer to circular double stranded DNA loops which are typically maintained episomally but may also be integrated into the host genome. In some embodiments, the present invention accordingly provides a host cell comprising the DNA encoding the protein and a process of producing the protein comprising culturing the host cell under conditions conducive to the production of the protein, and recovering the protein.

Exemplary embodiments of the activity of wild type FAD-GDHα (SEQ ID NO: 38) is shown in International Application Serial No. PCT/US2015/64125, entitled "Compositions and Methods for Measuring Blood Glucose Levels", filed on Dec. 4, 2015.

Exemplary embodiments of the activity of mutated GAD-GDHα is in International Application Serial No. PCT/US2015/64125, entitled "Compositions and Methods for Measuring Blood Glucose Levels", filed on Dec. 4, 2015.

Figure 1A:
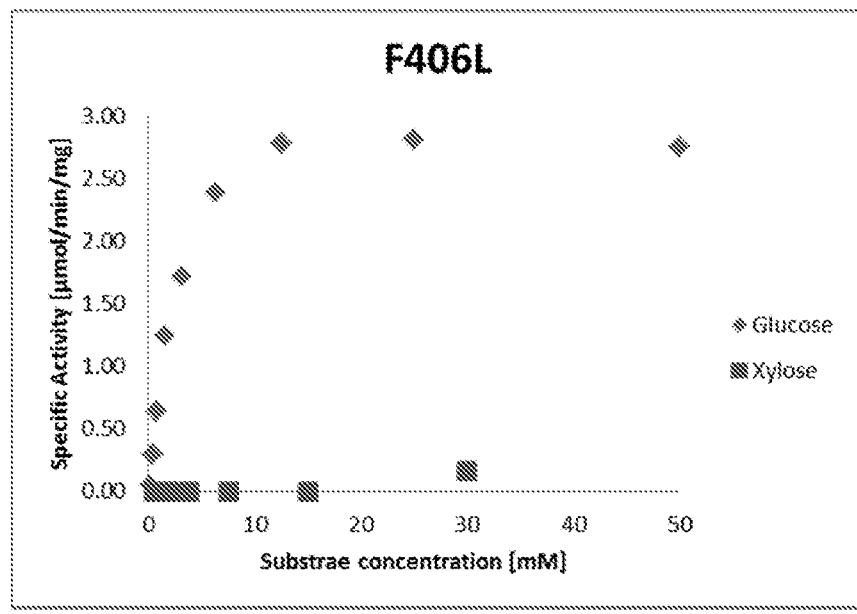
FIGS. 1A and 1B show some aspects of some embodiments of the present invention.
Figure 1B:
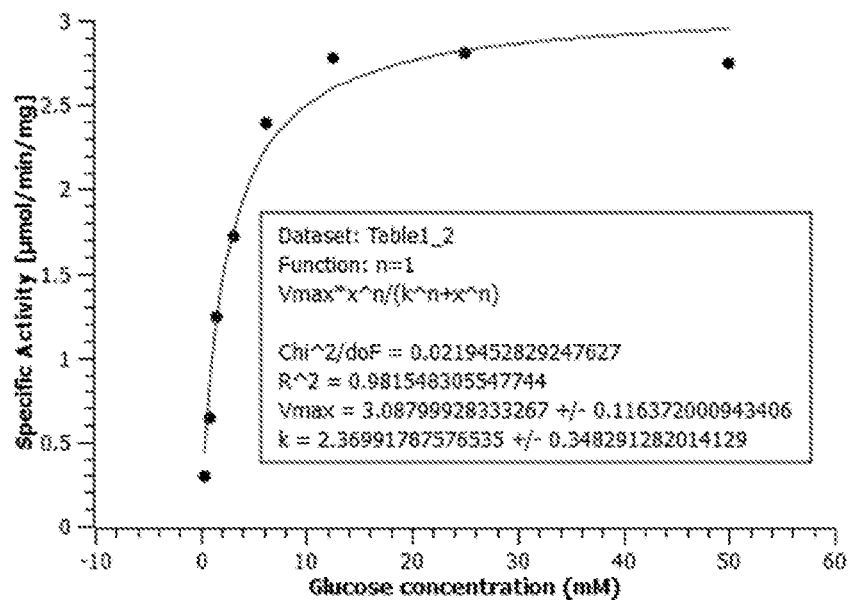

Exemplary embodiments of the composition of the present invention are shown in FIGS. 1A and 1B. FIG. 1A shows the biochemical response of FAD-GDHα F406L to varying concentrations of glucose (rhombus), and xylose (rectangle). FIG. 1B shows the biochemical response of F406L to glucose and the non-linear fit through which $K_m(k)$ and $V_{max}$ have been obtained. F406L enzyme activity was determined via monitoring decrease of Dichlorophenolindophenol (DCIP) signal at $OD_{600}$.

Figure 2:
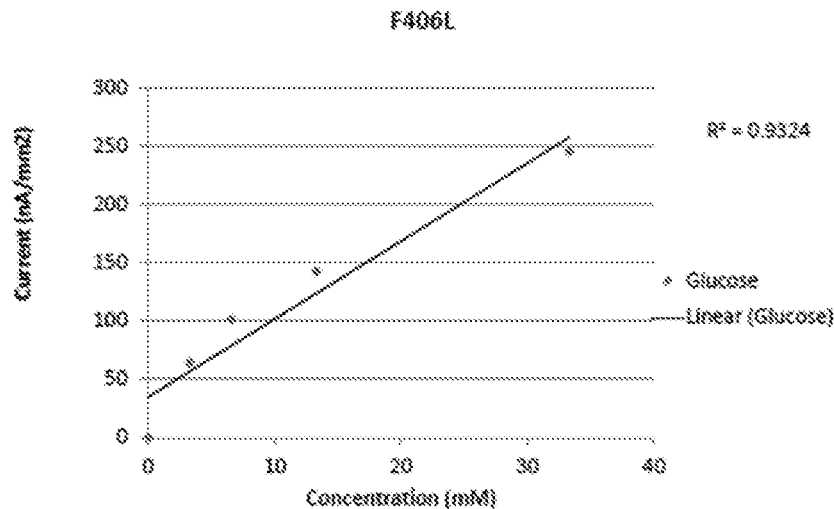
FIG. 2 shows some aspects of an embodiment of the composition of the present invention, showing the electrochemical data in connection with FAD-GDHα F406L.

An exemplary embodiment of the composition of the present invention, showing the electrochemical data in connection with FAD-GDHα F406L, is shown in FIG. 2.

Figure 3A:
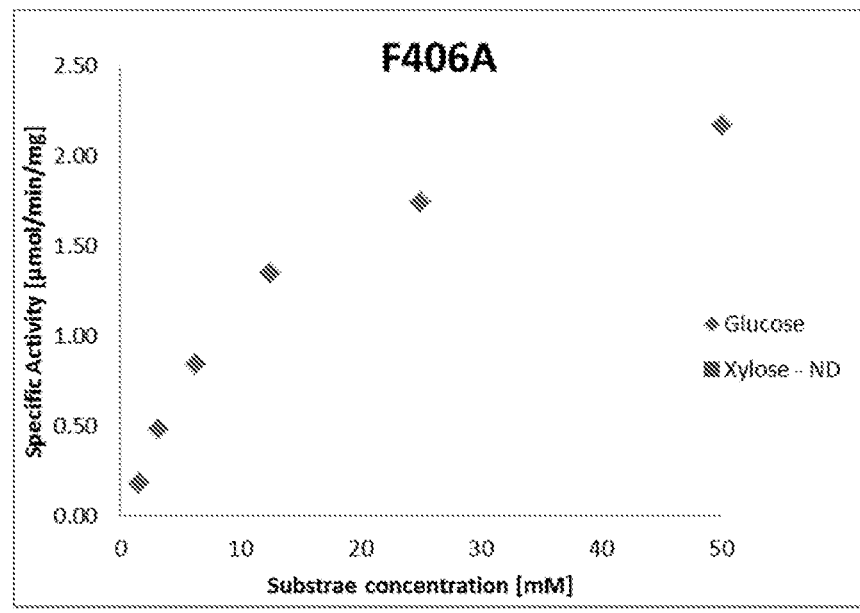
FIGS. 3A-3C show some aspects of some embodiments of the present invention.
Figure 3B:
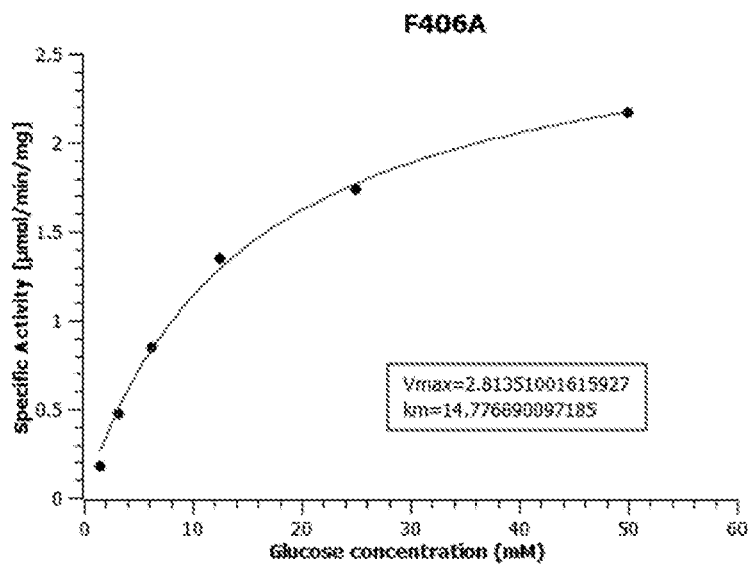
Figure 3C:
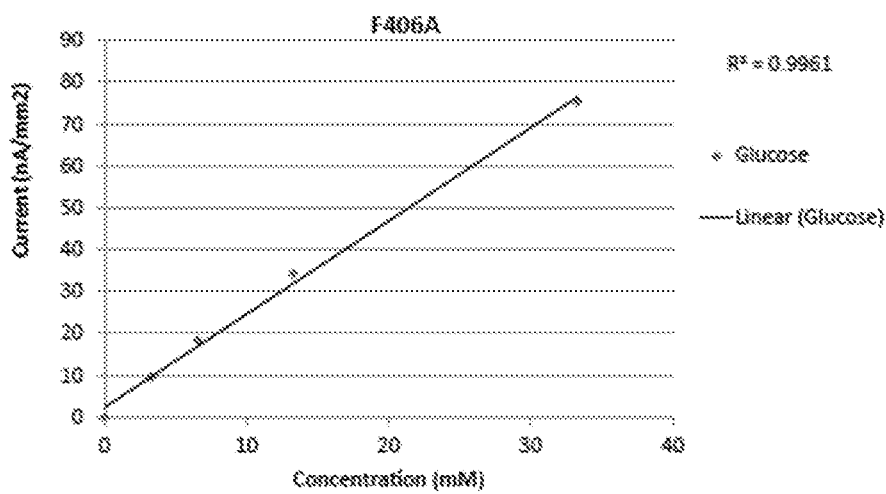

Exemplary embodiments of the composition of the present invention are shown in FIGS. 3A-3C. FIG. 3A shows the biochemical response of FAD-GDHα F406A to varying concentrations of glucose (rhombus), and xylose (rectangle). FIG. 3B shows the biochemical response of F406A to glucose and the non-linear fit through which $K_m$ (k) and $V_{max}$ have been obtained. F406A enzyme activity was determined via monitoring decrease of Dichlorophenolindophenol (DCIP) signal at $OD_{600}$. FIG. 3C shows electrochemical data representing the current response of the biosensor to various glucose concentrations (shown as a rhombus) and the linear fit across the data range is represented by the $R^2$ value.

Figure 4A:
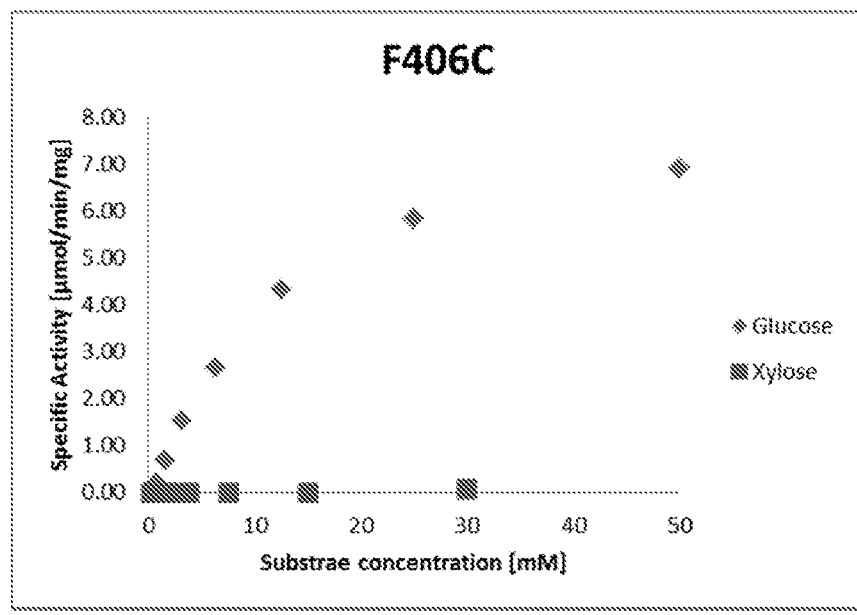
FIGS. 4A-C show some aspects of some embodiments of the present invention.
Figure 4B:
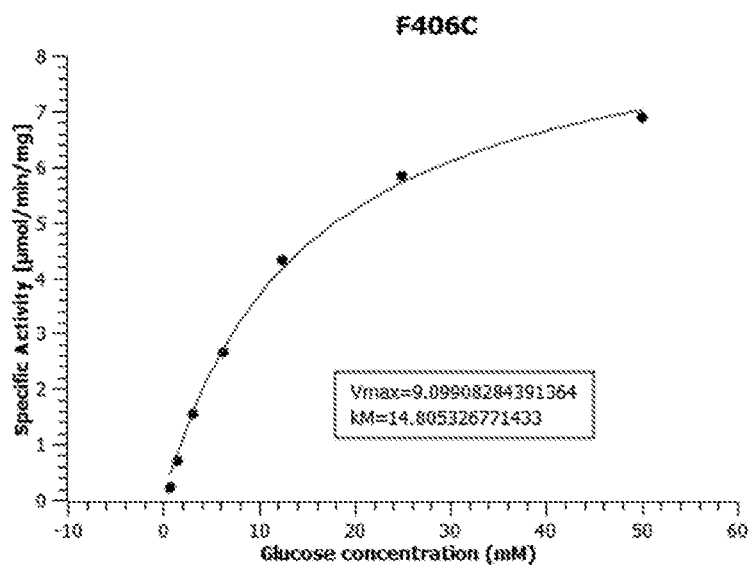
Figure 4C:
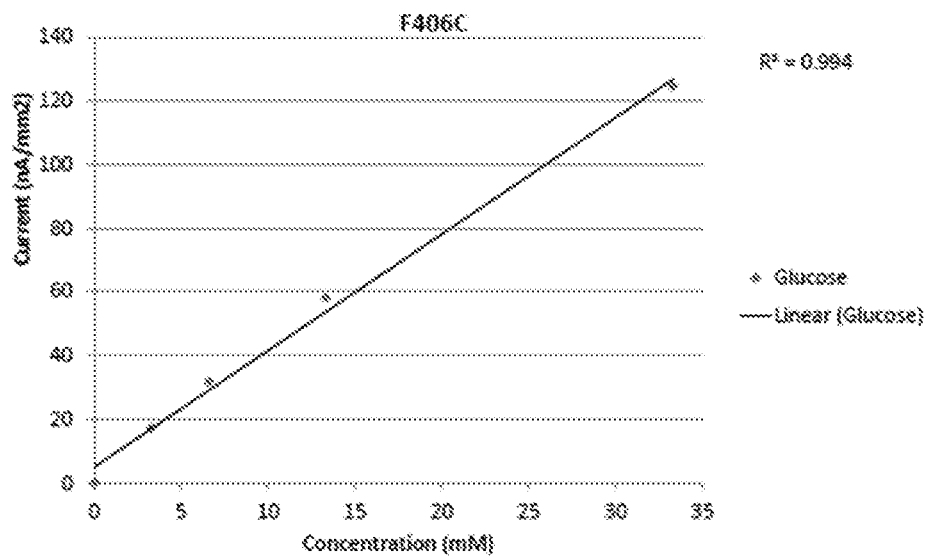

Exemplary embodiments of the compositions of the present invention are shown in FIGS. 4A-C. FIG. 4A shows the biochemical response of FAD-GDHα F406C to varying concentrations of glucose (rhombus), and xylose (rectangle). FIG. 4B shows the iochemical response of F406C to glucose and the non-linear fit through which $K_m$ (k) and $V_{max}$ have been obtained. F406C enzyme activity was determined monitoring decrease of Dichlorophenolindophenol (DCIP) signal at $OD_{600}$. FIG. 4C shows the electrochemical data representing the current response of the biosensor to various glucose concentrations (shown as a rhombus) and the linear fit across the data range is represented by the $R^2$ value.

Figure 5A:
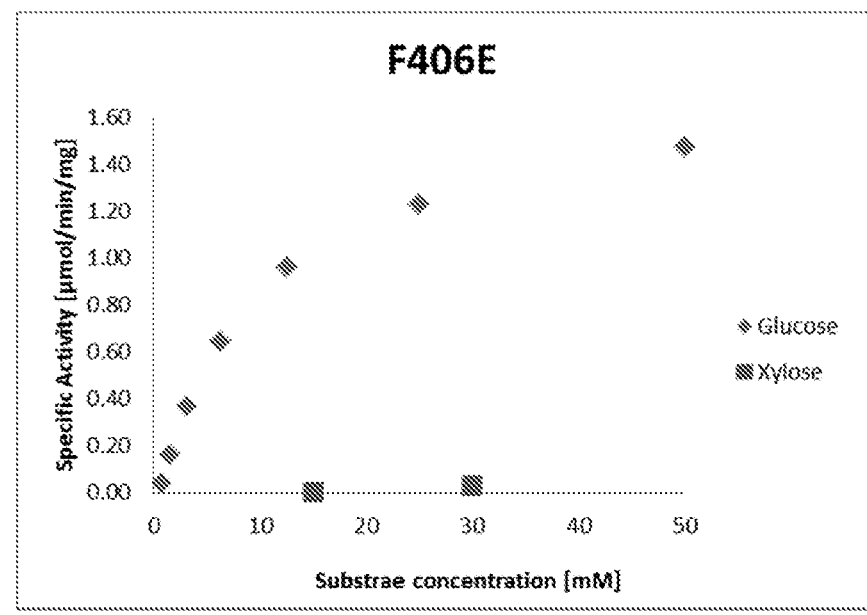
FIGS. 5A-C shows aspects of some embodiments of the present invention.
Figure 5B:
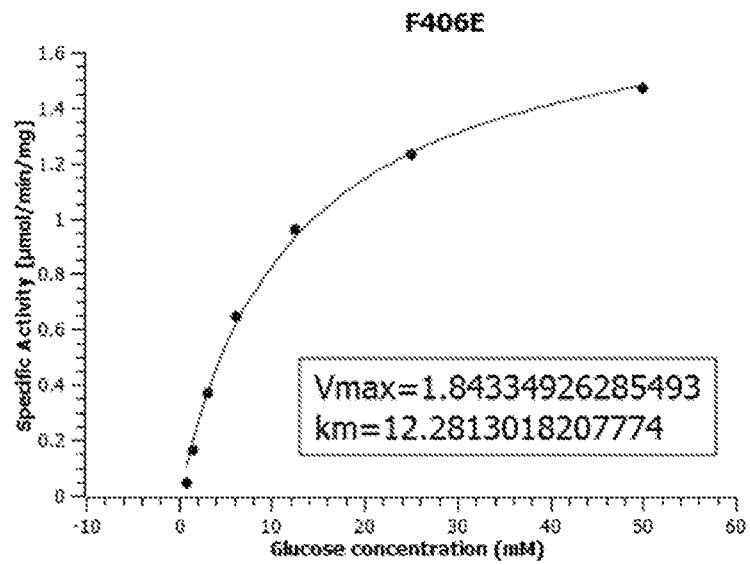
Figure 5C:
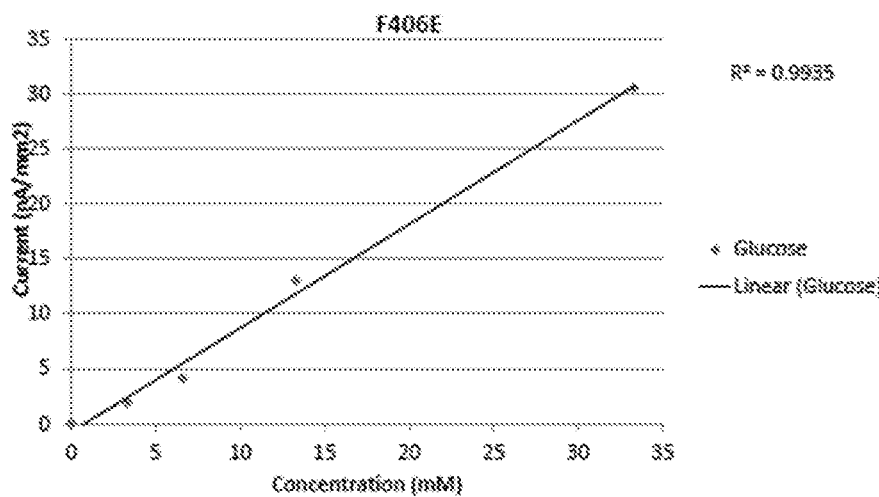

Exemplary embodiments of the compositions of the present invention are shown in FIGS. 5A-C. FIG. 5A shows the biochemical response of FAD-GDHα F406E to varying concentrations of glucose (rhombus), and xylose (rectangle). FIG. 5B shows the biochemical response of F406E to glucose and the non-linear fit through which $K_m$ (k) and $V_{max}$ have been obtained. F406E enzyme activity was determined via monitoring decrease of Dichlorophenolindophenol (DCIP) signal at $OD_{600}$. FIG. 5C shows electrochemical data representing the current response of the biosensor to various glucose concentrations (shown as a rhombus) and the linear fit across the data range is represented by the $R^2$ value.

Figure 6A:
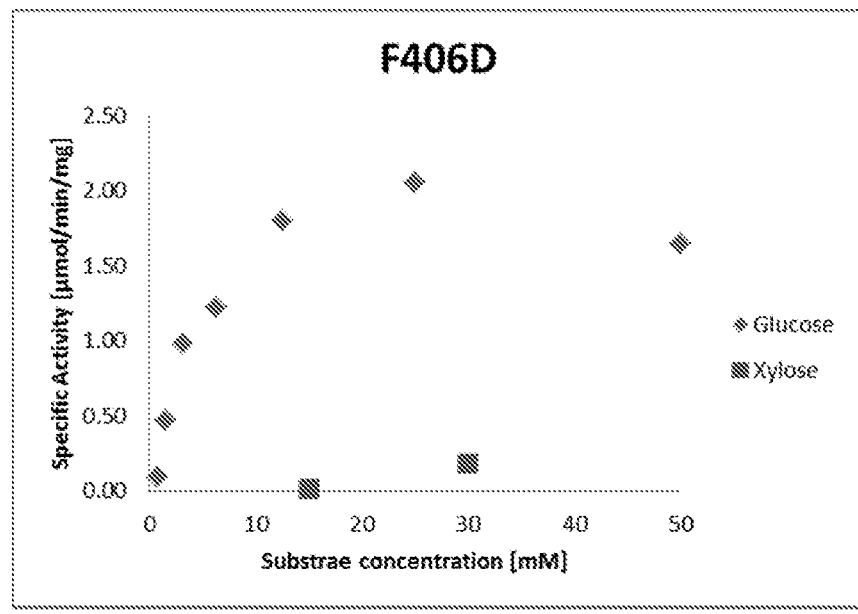
FIGS. 6A-C show some aspects of some embodiments of the present invention.
Figure 6B:
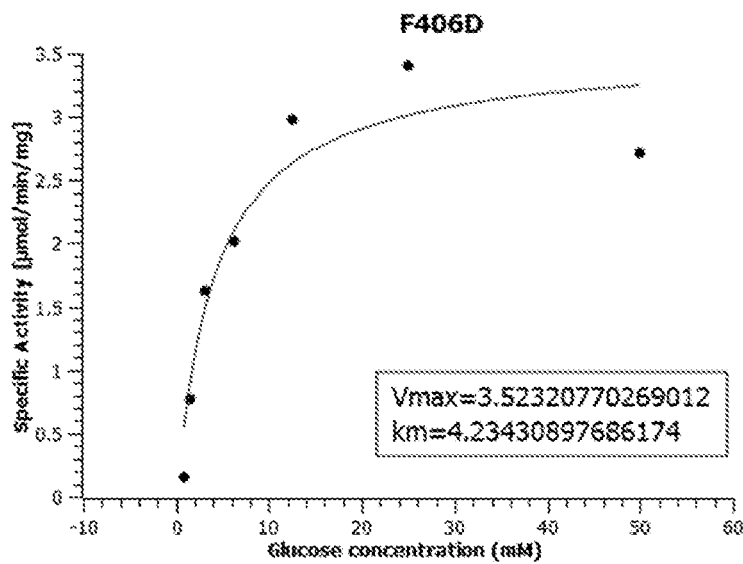
Figure 6C:
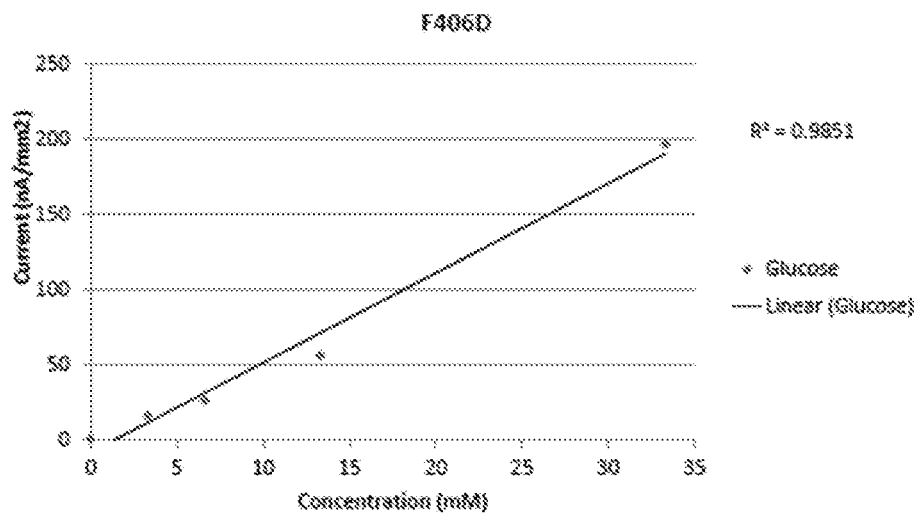

Exemplary embodiments of the compositions of the present invention are shown in FIGS. 6A-C. FIG. 6A shows the biochemical response of FAD-GDHα F406D to varying concentrations of glucose (rhombus), and xylose (rectangle). FIG. 6B shows the biochemical response of F406D to glucose and the non-linear fit through which $K_m$ (k) and $V_{max}$ have been obtained. F406D enzyme activity was determined via monitoring decrease of Dichlorophenolindophenol (DCIP) signal at $OD_{600}$. FIG. 6C shows the electrochemical data representing the current response of the biosensor to various glucose concentrations (shown as a rhombus) and the linear fit across the data range is represented by the $R^2$ value.

Figure 7A:
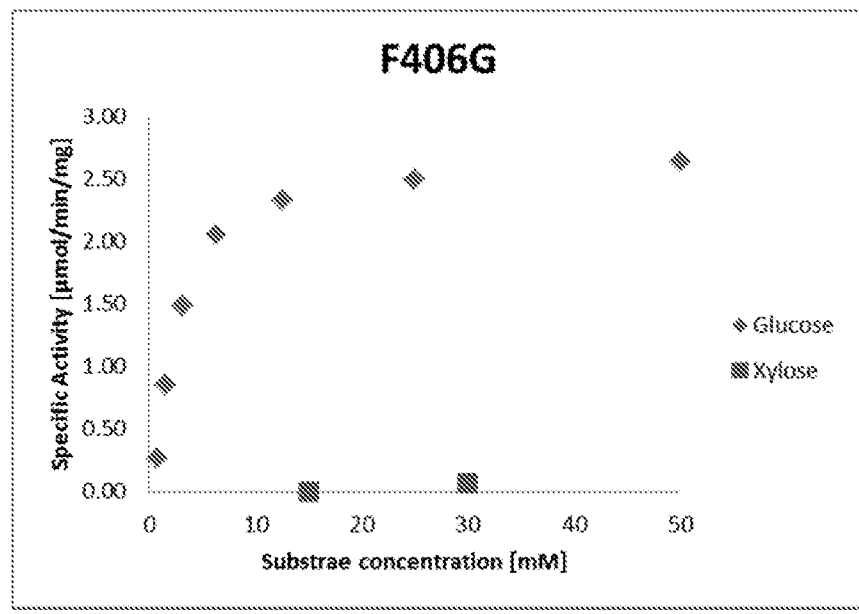
FIGS. 7A-C show some aspects of some embodiments of the present invention.
Figure 7B:
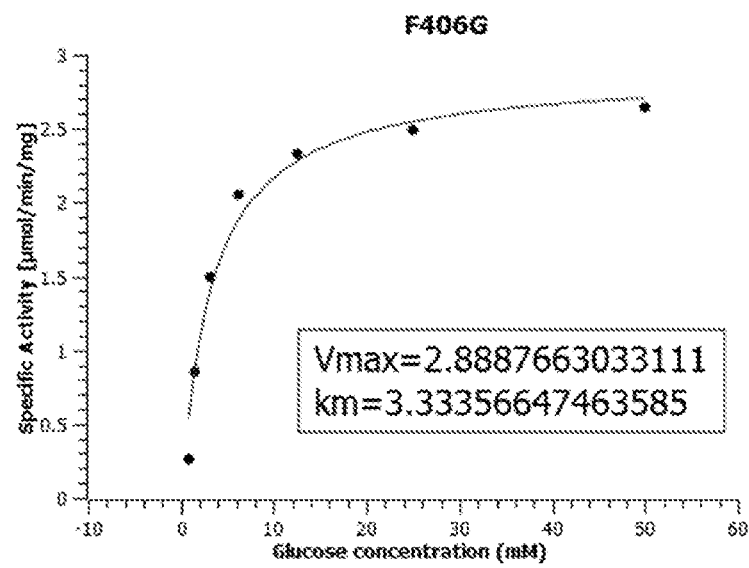
Figure 7C:
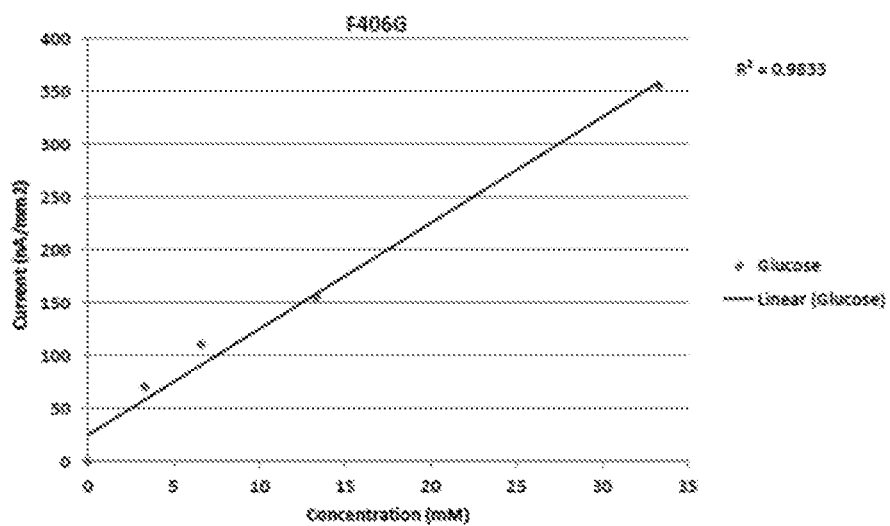

Exemplary embodiments of the compositions of the present invention are shown in FIGS. 7A-C. FIG. 7A shows the biochemical response of FAD-GDHα F406G to varying concentrations of glucose (rhombus), and xylose (rectangle). FIG. 7B shows the biochemical response of F406G to glucose and the non-linear fit through which $K_m$ (k) and $V_{max}$ have been obtained. F406G enzyme activity was determined via monitoring decrease of Dichlorophenolindophenol (DCIP) signal at $OD_{600}$. FIG. 7C shows electrochemical data representing the current response of the biosensor to various glucose concentrations (shown as a rhombus) and the linear fit across the data range is represented by the $R^2$ value.

Figure 8A:
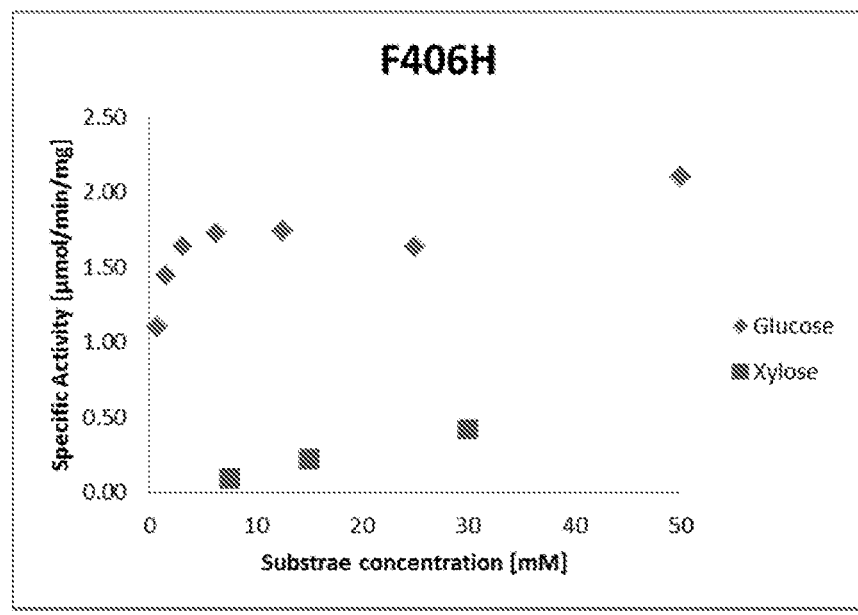
FIGS. 8A and 8B show aspects of some embodiments of the present invention.
Figure 8B:
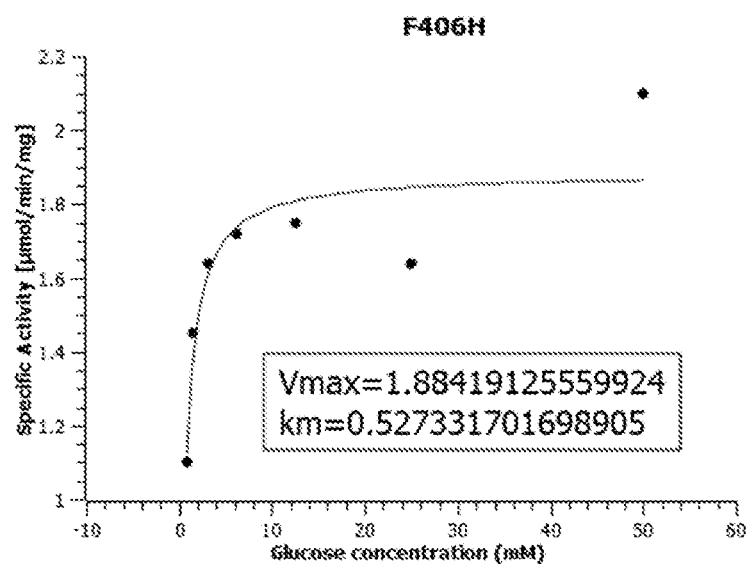

Exemplary embodiments of the compositions of the present invention are shown in FIGS. 8A and 8B. FIG. 8A shows the biochemical response of FAD-GDHα F406H to varying concentrations of glucose (rhombus), and xylose (rectangle). FIG. 8B shows the biochemical response of F406H to glucose and the non-linear fit through which $K_m$(k) and $V_{max}$ have been obtained. F406H enzyme activity was determined via monitoring decrease of Dichlorophenolindophenol (DCIP) signal at $OD_{600}$.

Figure 9A:
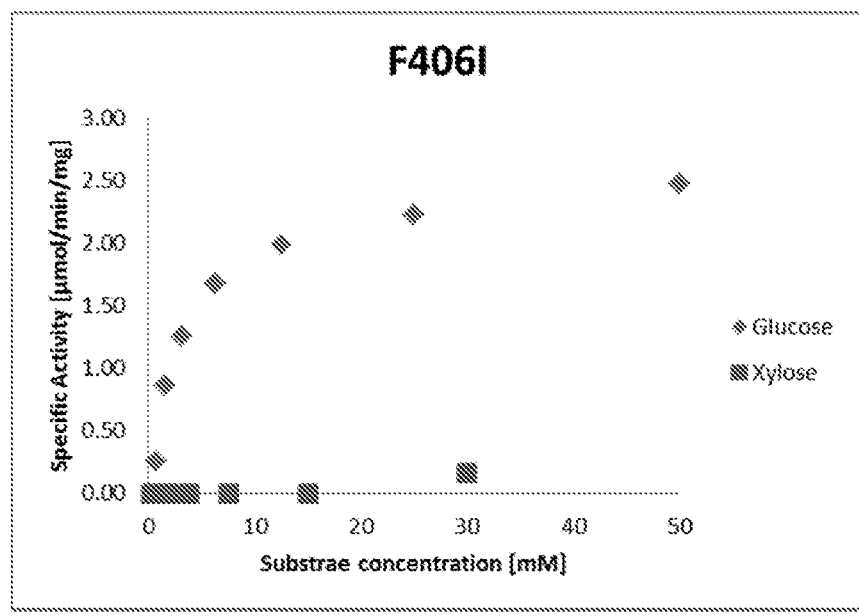
FIGS. 9A-C show some aspects of some embodiments of the present invention.
Figure 9B:
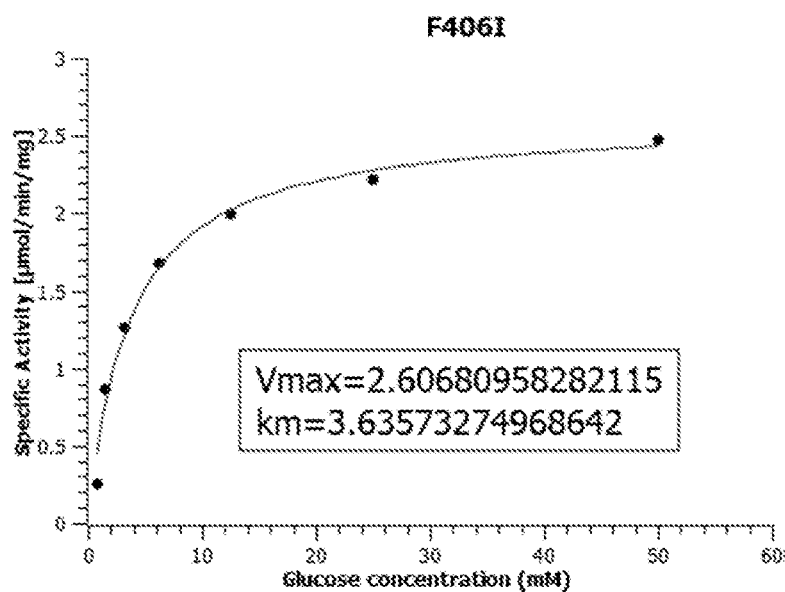
Figure 9C:
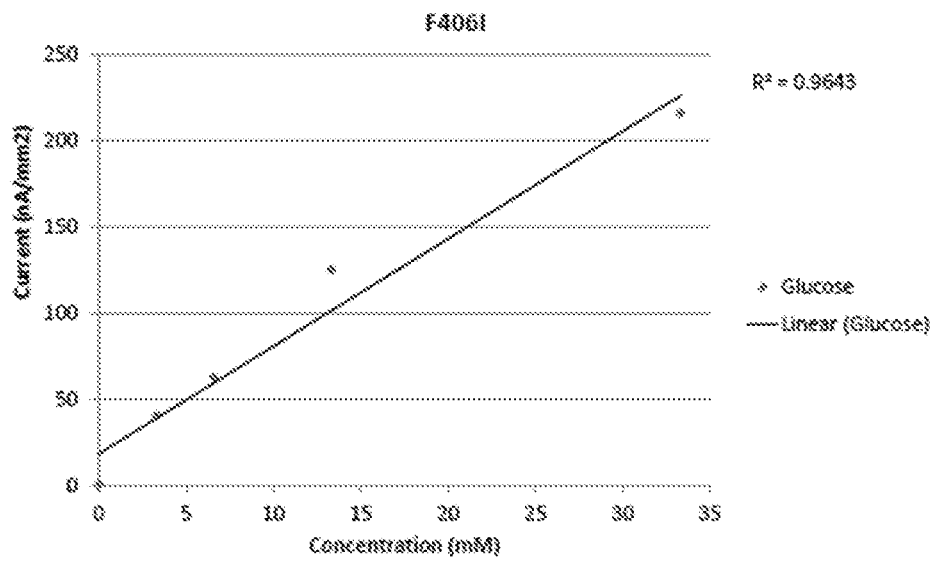

Exemplary embodiments of the compositions of the present invention are shown in FIGS. 9A-C. FIG. 9A shows the biochemical response of FAD-GDHα F406I to varying concentrations of glucose (rhombus), and xylose (rectangle). FIG. 9B shows the biochemical response of F406I to glucose and the non-linear fit through which $K_m$ (k) and $V_{max}$ have been obtained. F406I enzyme activity was determined via monitoring decrease of Dichlorophenolindophenol (DCIP) signal at $OD_{600}$. FIG. 9C shows electrochemical data representing the current response of the biosensor to various glucose concentrations (shown as a rhombus) and the linear fit across the data range is represented by the $R^2$ value.

Figure 10A:
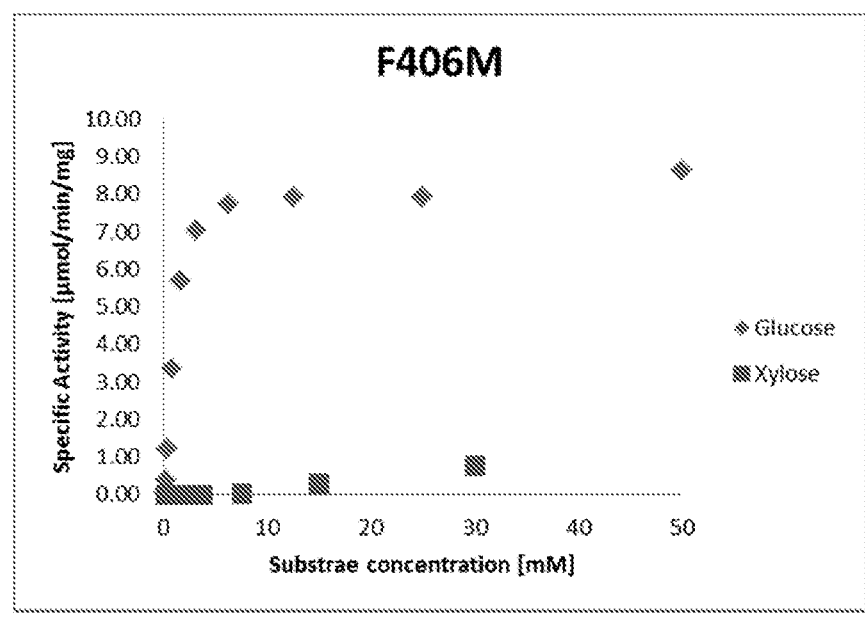
FIGS. 10A and 10B show some aspects of some embodiments of the present invention.
Figure 10B:
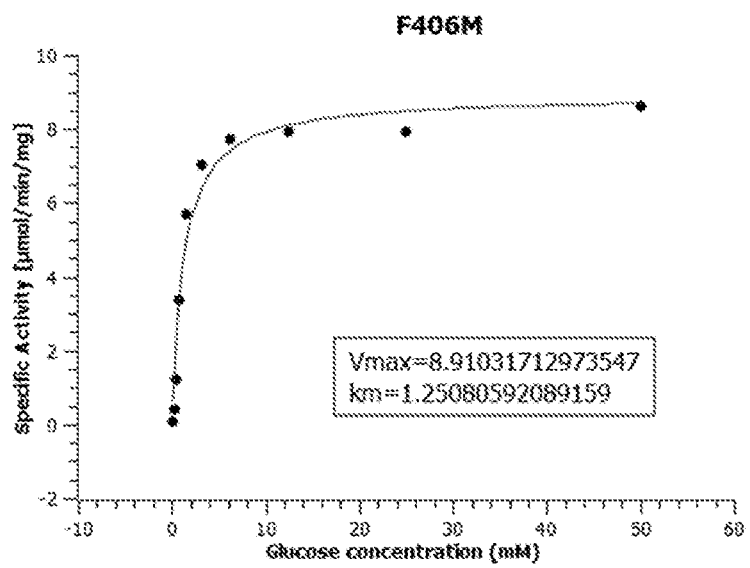

Exemplary embodiments of the compositions of the present invention are shown in FIGS. 10A and 10B. FIG. 10A shows the biochemical response of FAD-GDHα F406M to varying concentrations of glucose (rhombus), and xylose (rectangle). FIG. 10B shows the biochemical response of F406M to glucose and the non-linear fit through which $K_m$ (k) and $V_{max}$ have been obtained. F406M enzyme activity was determined via monitoring decrease of Dichlorophenolindophenol (DCIP) signal at $OD_{600}$.

Figure 11A:
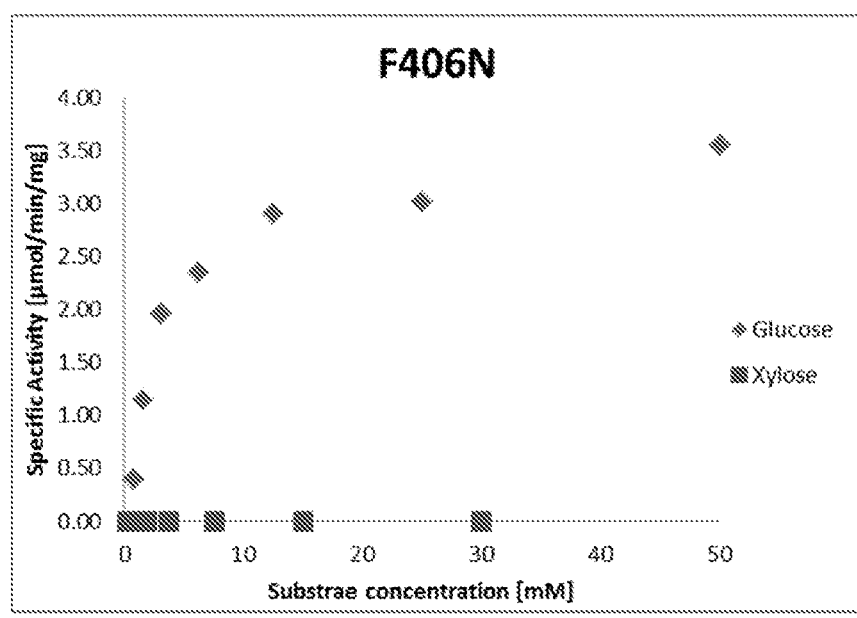
FIGS. 11A-C show some aspects of some embodiments of the present invention.
Figure 11B:
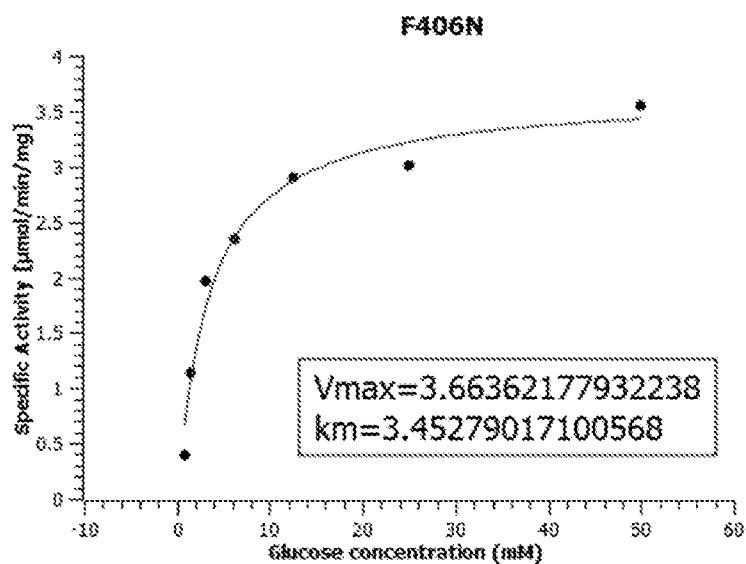
Figure 11C:
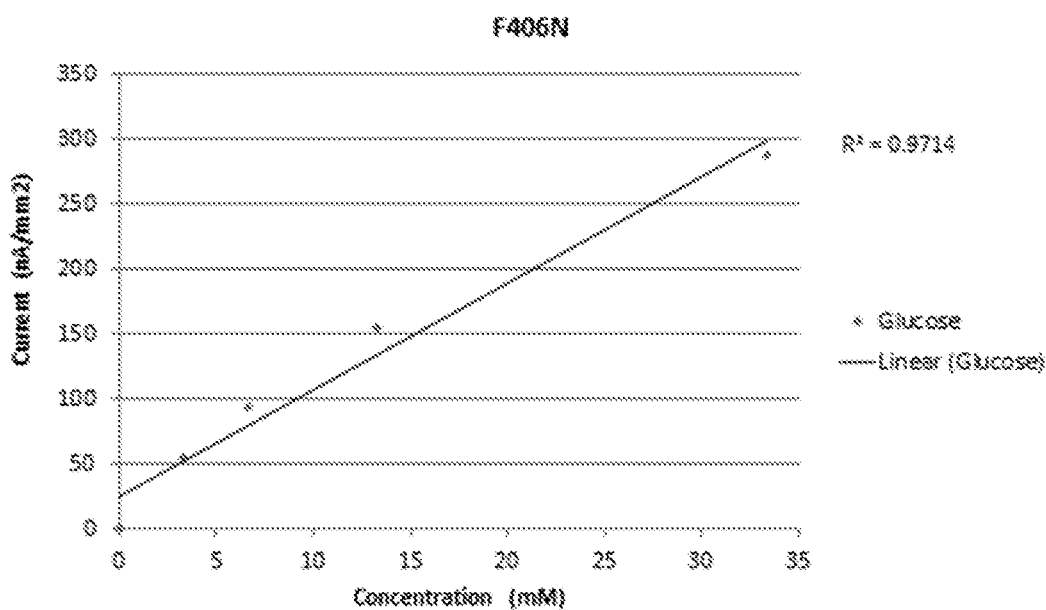

Exemplary embodiments of the compositions of the present invention are shown in FIGS. 11A-C. FIG. 11A shows the biochemical response of FAD-GDHα F406N to varying concentrations of glucose (rhombus), and xylose (rectangle). FIG. 11B shows the biochemical response of F406N to glucose and the non-linear fit through which $K_m$(k) and $V_{max}$ have been obtained. F406N enzyme activity was determined via monitoring decrease of Dichlorophenolindophenol (DCIP) signal at $OD_{600}$. FIG. 11C shows electrochemical data representing the current response of the biosensor to various glucose concentrations (shown as a rhombus) and the linear fit across the data range is represented by the $R^2$ value.

Figure 12A:
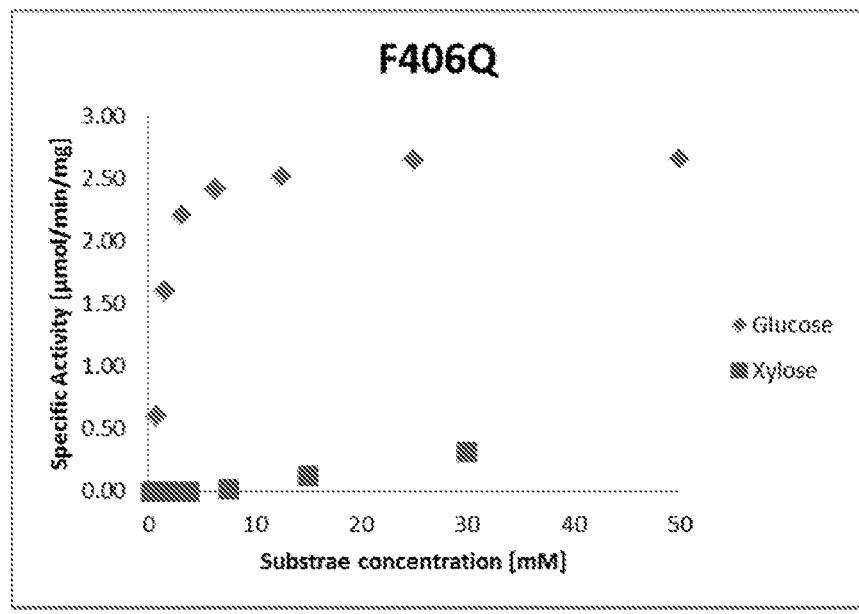
FIGS. 12A and 12B show some aspects of some embodiments of the present invention.
Figure 12B:
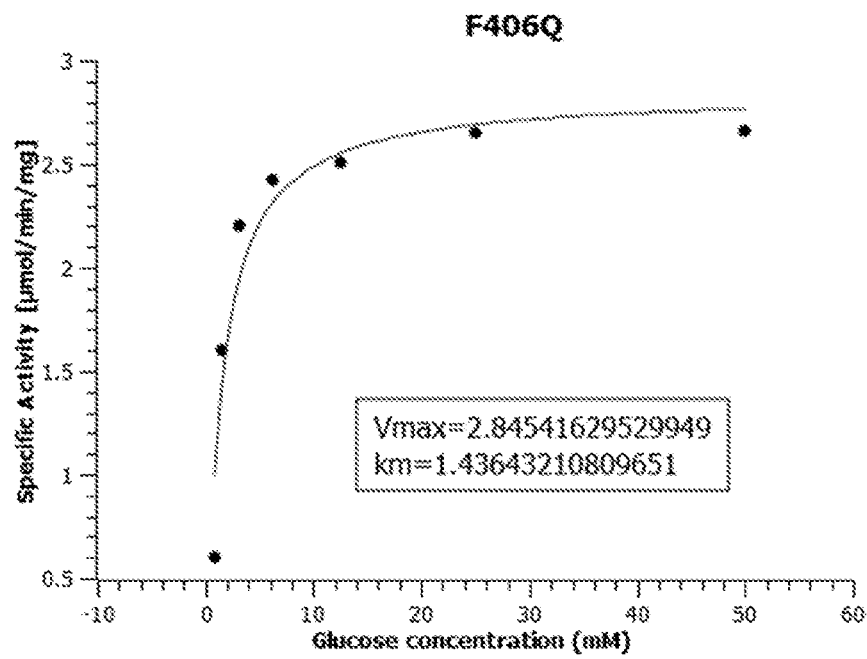

Exemplary embodiments of the compositions of the present invention are shown in FIGS. 12A and 12B. FIG. 12A shows the biochemical response of FAD-GDHα F406Q to varying concentrations of glucose (rhombus), and xylose (rectangle). FIG. 12B shows the biochemical response of F406Q to glucose and the non-linear fit through which $K_m$(k) and $V_{max}$ have been obtained. F406Q enzyme activity was determined via monitoring decrease of Dichlorophenolindophenol (DCIP) signal at $OD_{600}$.

Figure 13A:
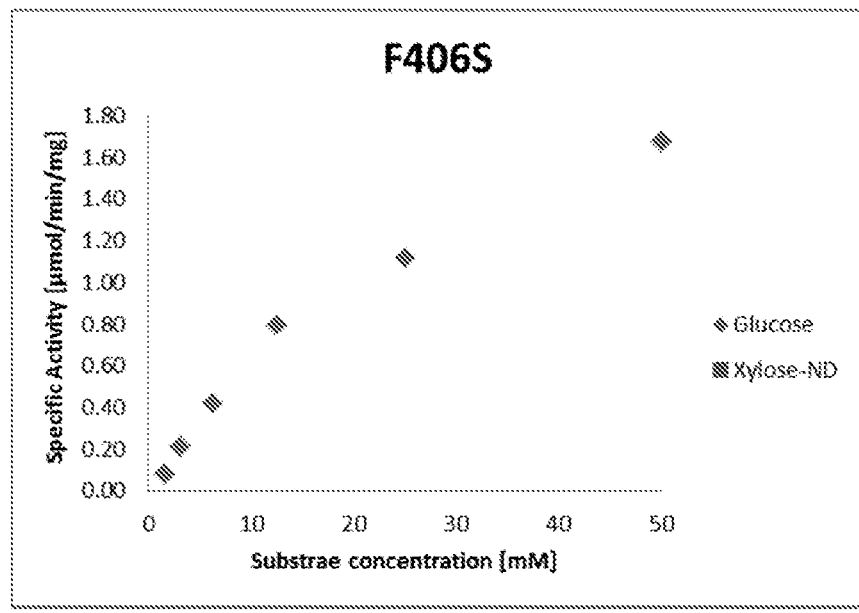
FIGS. 13A-C show some aspects of some embodiments of the present invention.
Figure 13B:
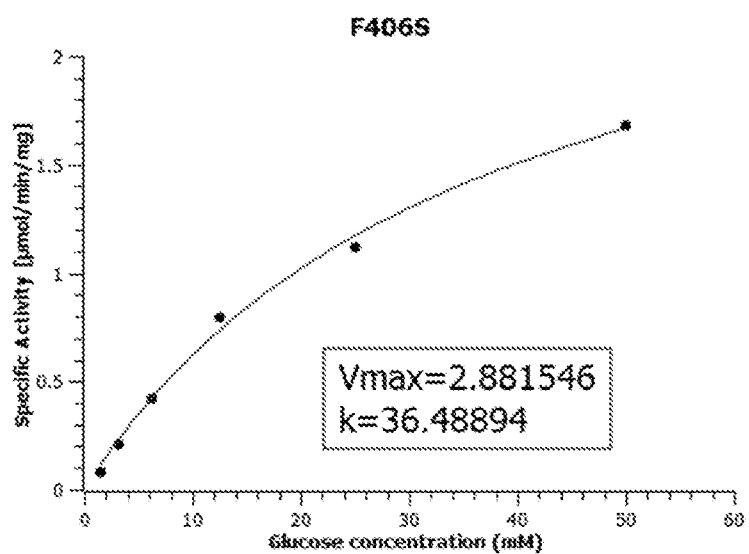
Figure 13C:
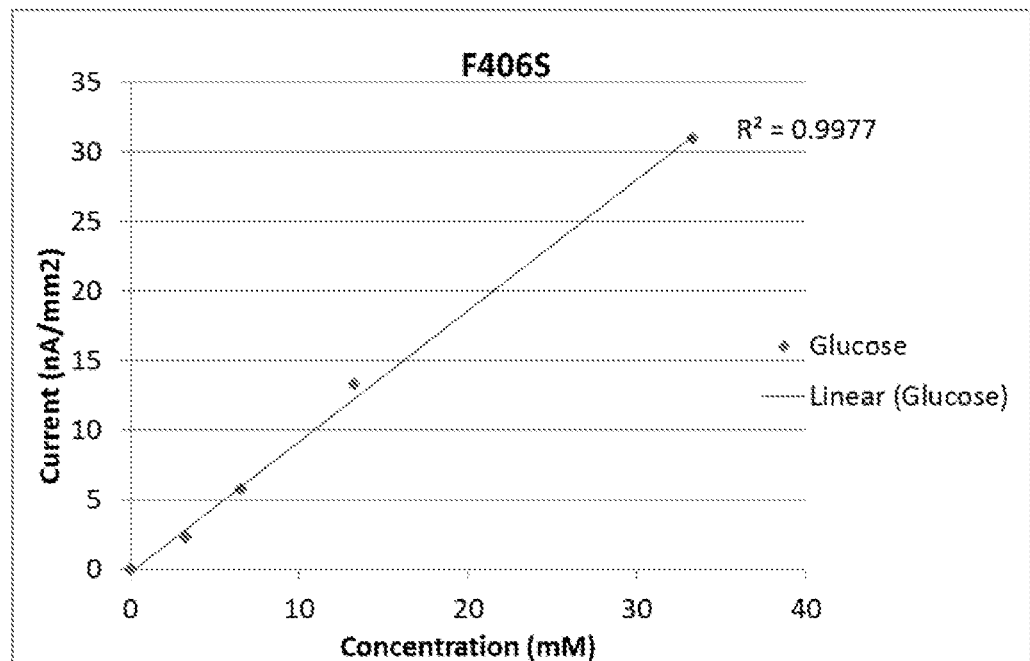

Exemplary embodiments of the compositions of the present invention are shown in FIGS. 13A-C. FIG. 13A shows biochemical response of FAD-GDHα F406S to varying concentrations of glucose (rhombus), and xylose (rectangle). FIG. 13B shows the biochemical response of F406S to glucose and the non-linear fit through which $K_m$ (k) and $V_{max}$ have been obtained. F406S enzyme activity was determined via monitoring decrease of Dichlorophenolindophenol (DCIP) signal at $OD_{600}$. FIG. 13C shows electrochemical data representing the current response of the biosensor to various glucose concentrations (shown as a rhombus) and the linear fit across the data range is represented by the $R^2$ value.

Figure 14A:
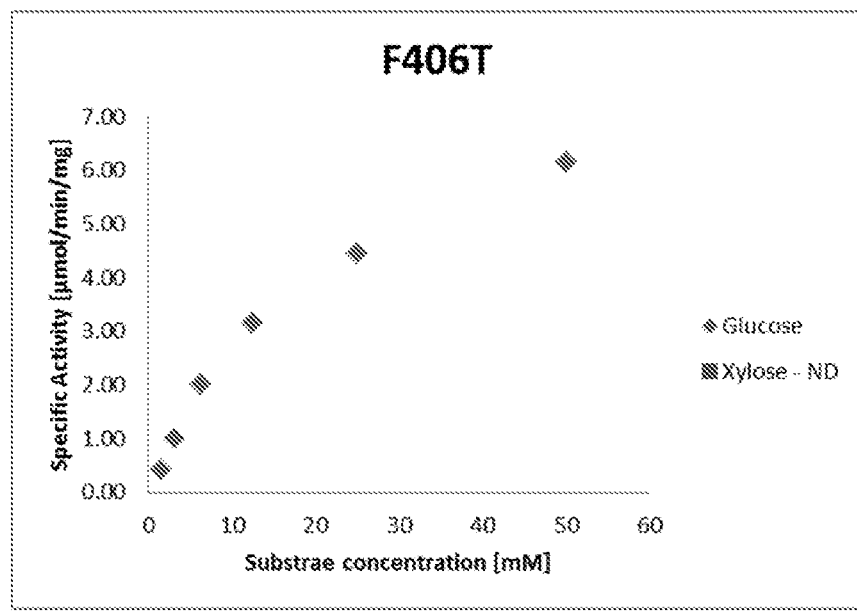
FIGS. 14A-C show some aspects of some embodiments of the present invention.
Figure 14B:
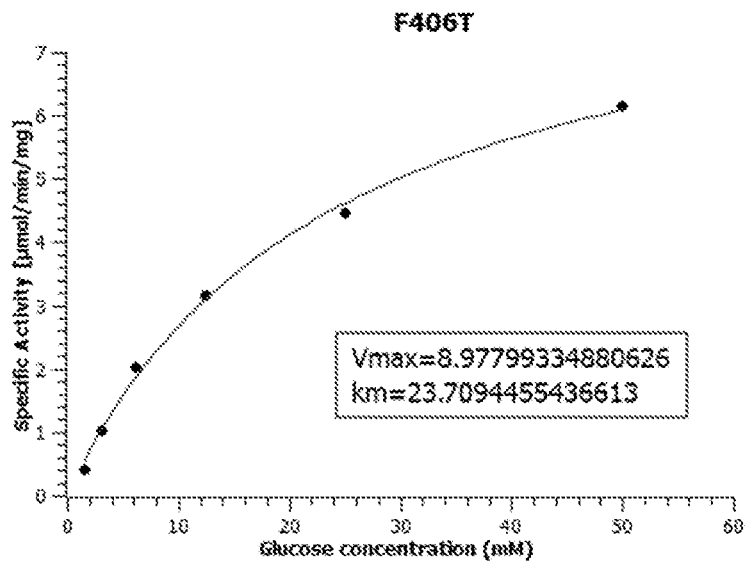
Figure 14C:
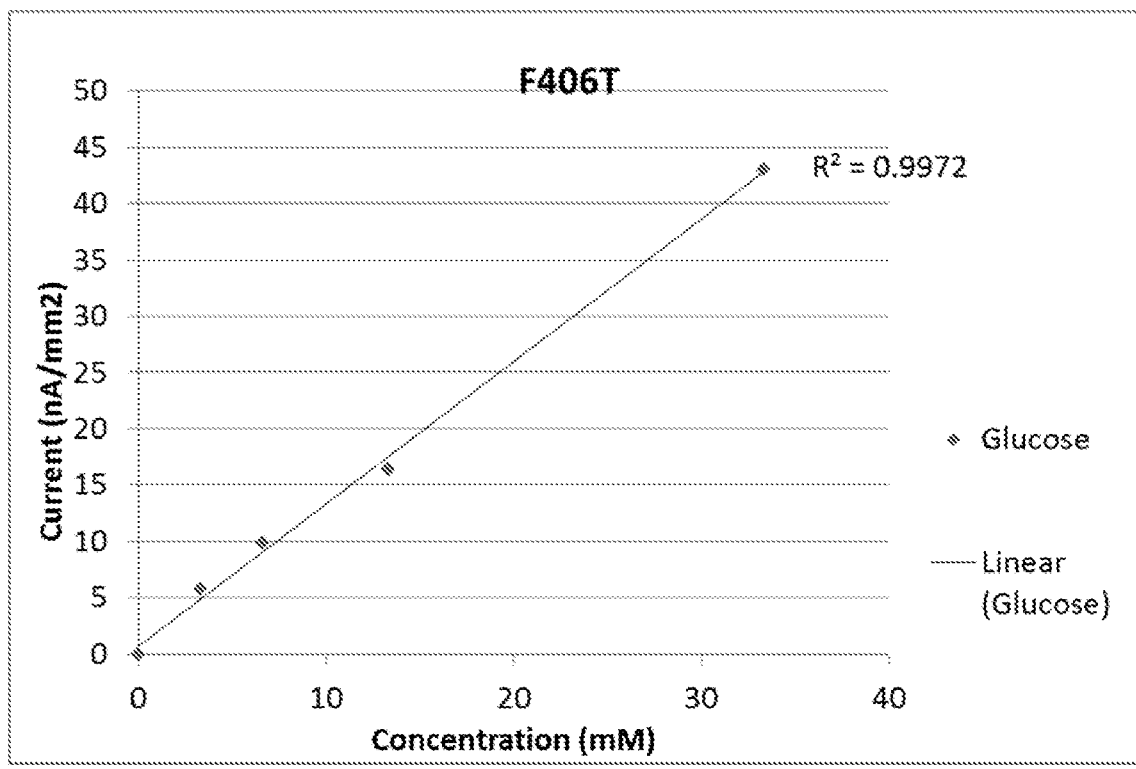

Exemplary embodiments of the compositions of the present invention are shown in FIGS. 14A-C. FIG. 14A shows the biochemical response of FAD-GDHα F406T to varying concentrations of glucose (rhombus), and xylose (rectangle). FIG. 14B shows biochemical response of F406T to glucose and the non-linear fit through which $K_m$ (k) and $V_{max}$ have been obtained. F406T enzyme activity was determined via monitoring decrease of Dichlorophenolindophenol (DCIP) signal at $OD_{600}$. FIG. 14C shows electrochemical data representing the current response of the biosensor to various glucose concentrations (shown as a rhombus) and the linear fit across the data range is represented by the $R^2$ value.

Figure 15A:
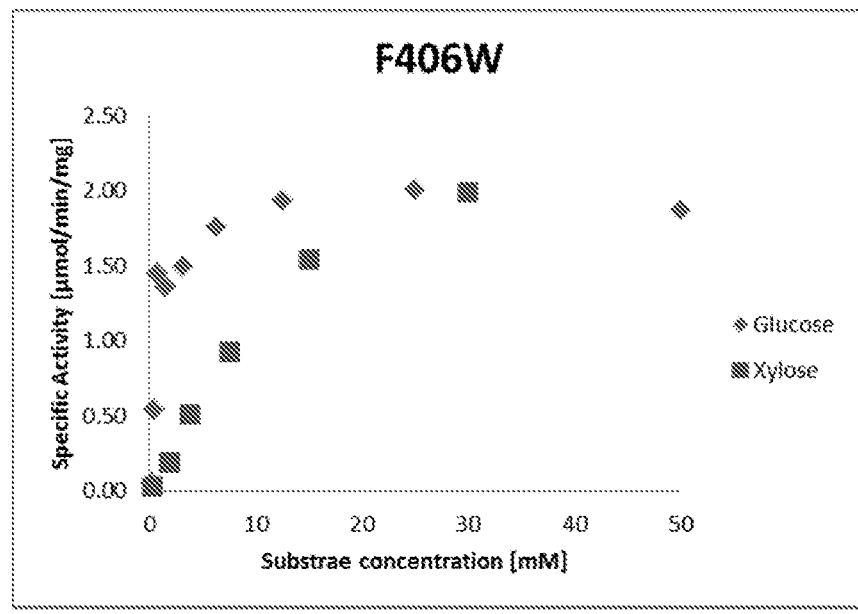
FIGS. 15A-B show negative results.
Figure 15B:
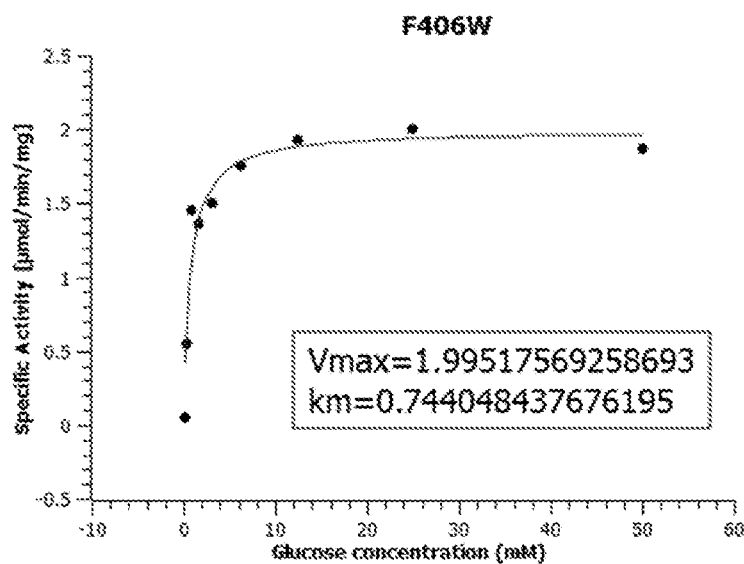

Exemplary embodiments of the compositions of the present invention are shown in FIGS. 15A-B. FIG. 15A shows a biochemical response of FAD-GDHα F406W to varying concentrations of glucose (rhombus), and xylose (rectangle). FIG. 15B shows a biochemical response of F406W to glucose and the non-linear fit through which $K_m$ (k) and $V_{max}$ have been obtained. F406W enzyme activity was determined via monitoring decrease of Dichlorophenolindophenol (DCIP) signal at $OD_{600}$.

Figure 16A:
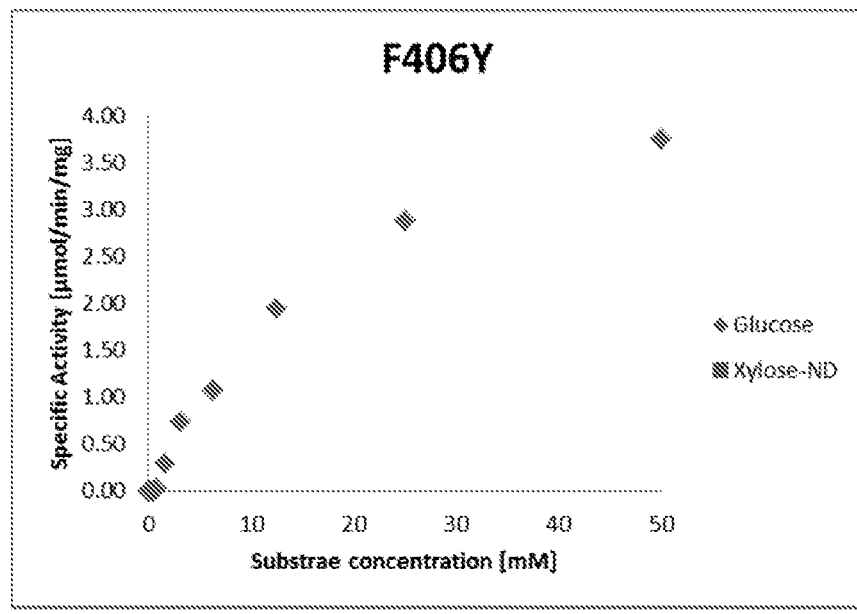
FIGS. 16A-C show some aspects of some embodiments of the present invention.
Figure 16B:
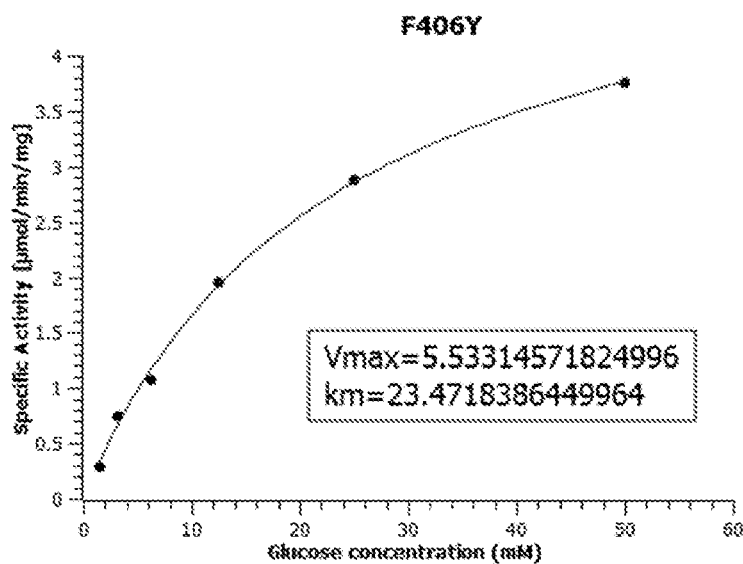
Figure 16C:
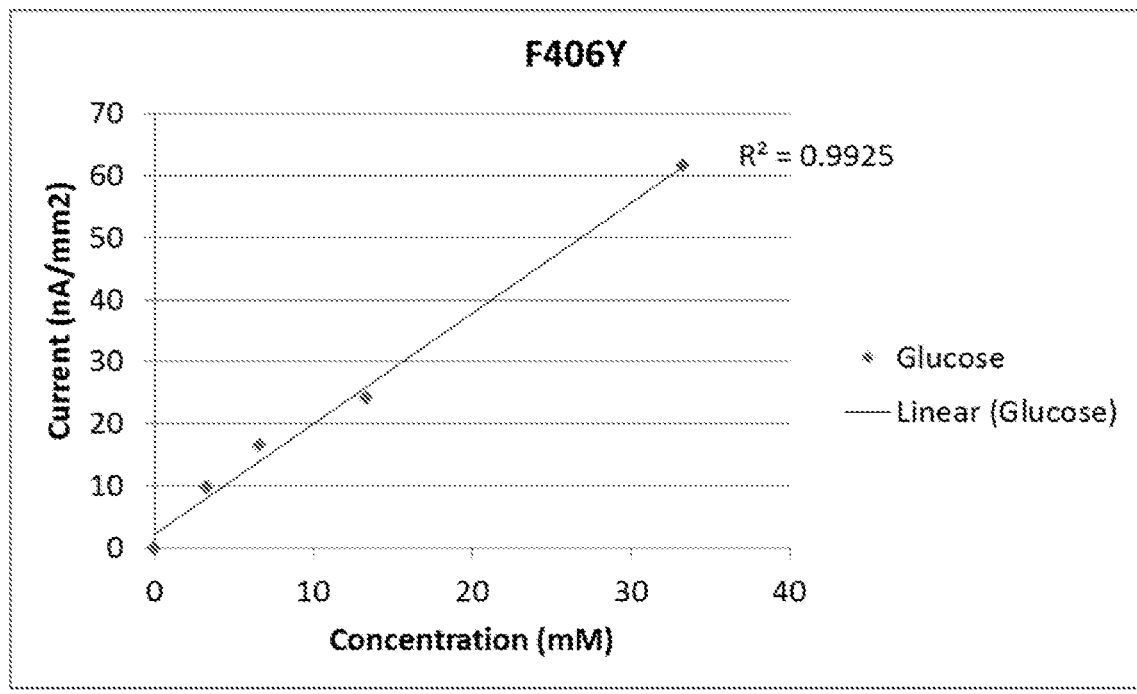

Exemplary embodiments of the compositions of the present invention are shown in FIGS. 16A-C. FIG. 16A shows the biochemical response of FAD-GDHα F406Y to varying concentrations of glucose (rhombus), and xylose (rectangle). FIG. 16B shows the biochemical response of F406Y to glucose and the non-linear fit through which $K_m$(k) and $V_{max}$ have been obtained. F406Y enzyme activity was determined via monitoring decrease of Dichlorophenolindophenol (DCIP) signal at $OD_{600}$. FIG. 16C shows electrochemical data representing the current response of the biosensor to various glucose concentrations (shown as a rhombus) and the linear fit across the data range is represented by the $R^2$ value.

Figure 17A:
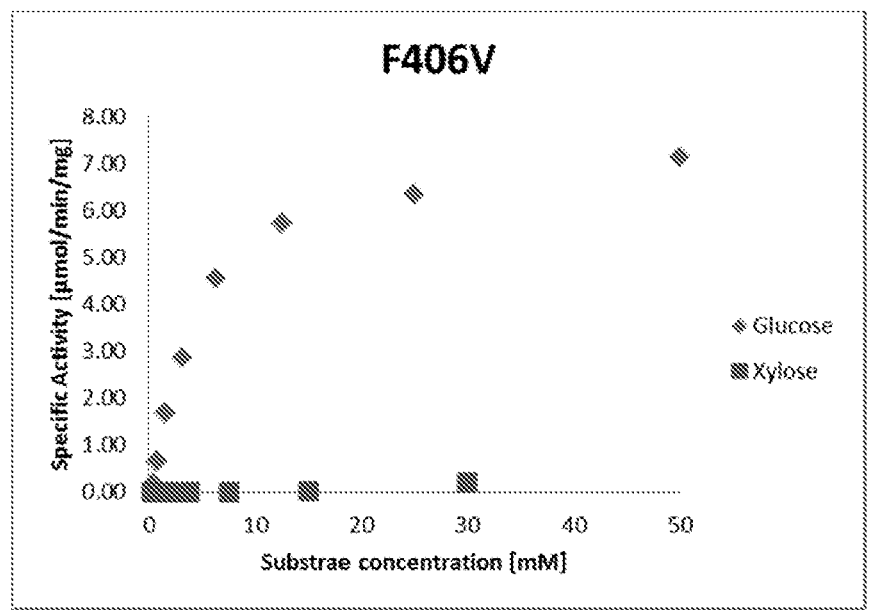
FIGS. 17A-C show some aspects of some embodiments of the present invention.
Figure 17B:
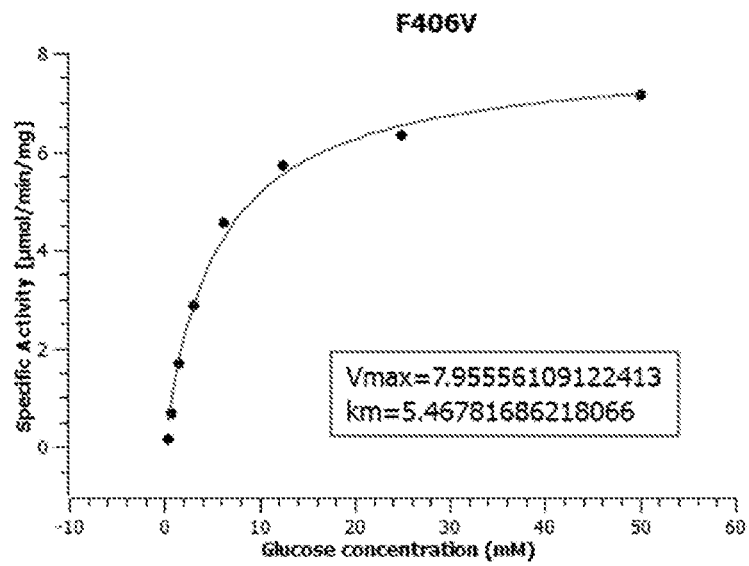
Figure 17C:
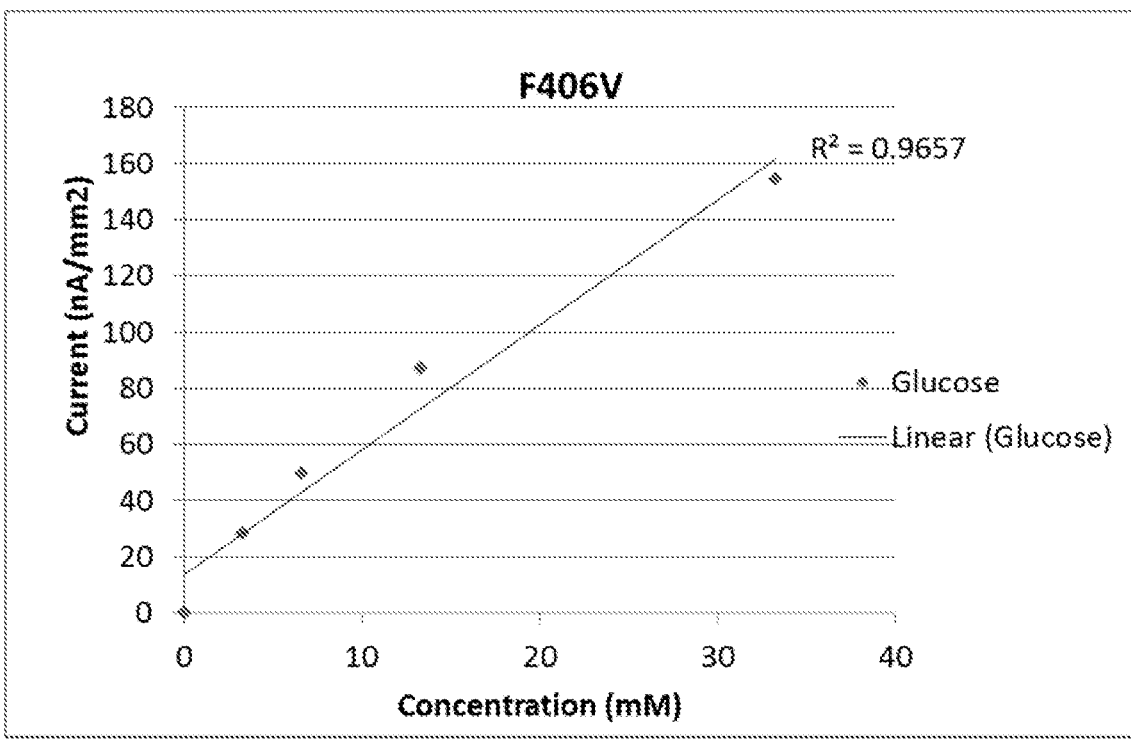

Exemplary embodiments of the compositions of the present invention are shown in FIGS. 17A-C. FIG. 17A shows the biochemical response of FAD-GDHα F406V to varying concentrations of glucose (rhombus), and xylose (rectangle). FIG. 17B shows the biochemical response of F406V to glucose and the non-linear fit through which $K_m$(k) and $V_{max}$ have been obtained. F406V enzyme activity was determined via monitoring decrease of Dichlorophenolindophenol (DCIP) signal at $OD_{600}$. FIG. 17C shows electrochemical data representing the current response of the biosensor to various glucose concentrations (shown as a rhombus) and the linear fit across the data range is represented by the $R^2$ value.

Figure 18A:
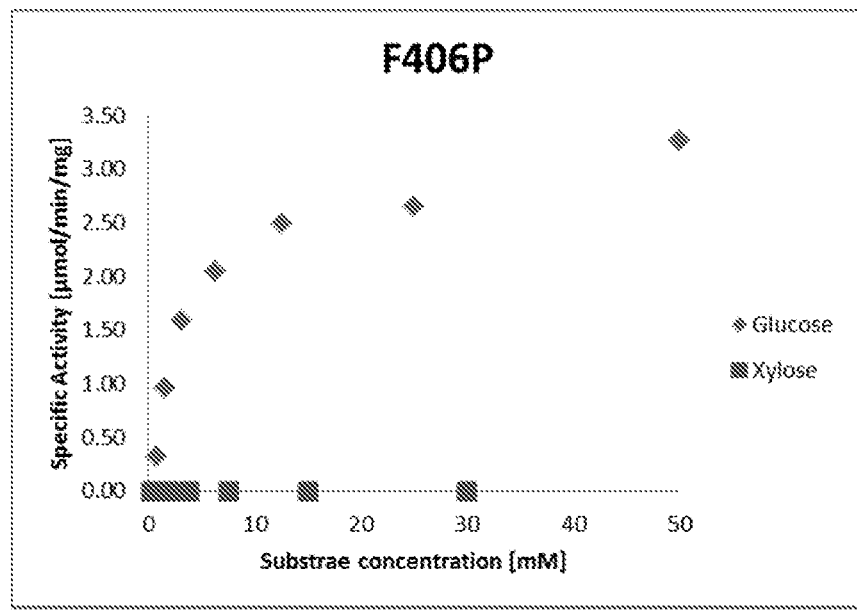
FIGS. 18A-C show some aspects of some embodiments of the present invention.
Figure 18B:
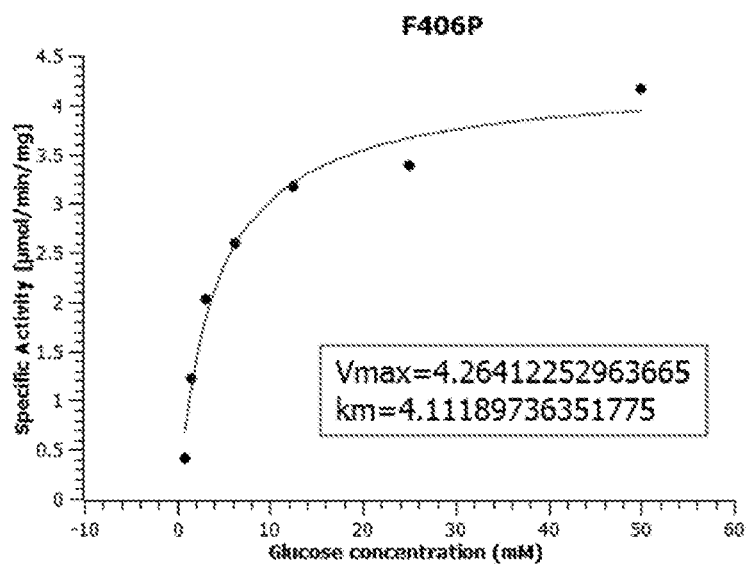
Figure 18C:
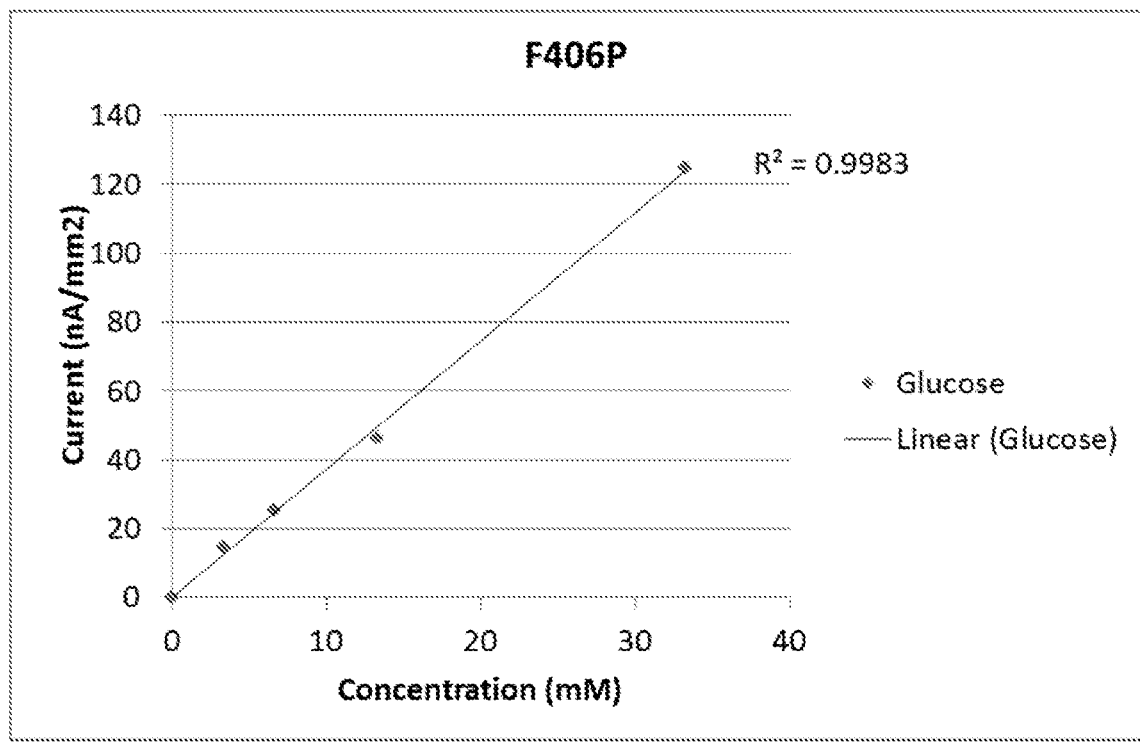

Exemplary embodiments of the compositions of the present invention are shown in FIGS. 18A-C. FIG. 18A shows the biochemical response of FAD-GDHα F406P to varying concentrations of glucose (rhombus), and xylose (rectangle). FIG. 18B shows the biochemical response of F406P to glucose and the non-linear fit through which $K_m$(k) and $V_{max}$ have been obtained. F406P enzyme activity was determined via monitoring decrease of Dichlorophenolindophenol (DCIP) signal at $OD_{600}$. FIG. 18C shows electrochemical data representing the current response of the biosensor to various glucose concentrations (shown as a rhombus) and the linear fit across the data range is represented by the $R^2$ value.

Figure 19A:
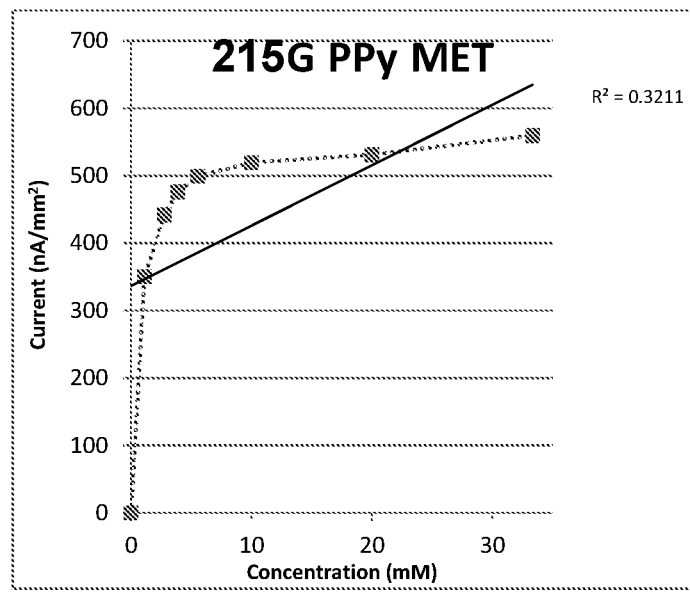
FIGS. 19A-B show some aspects of some embodiments of the present invention.
Figure 19B:
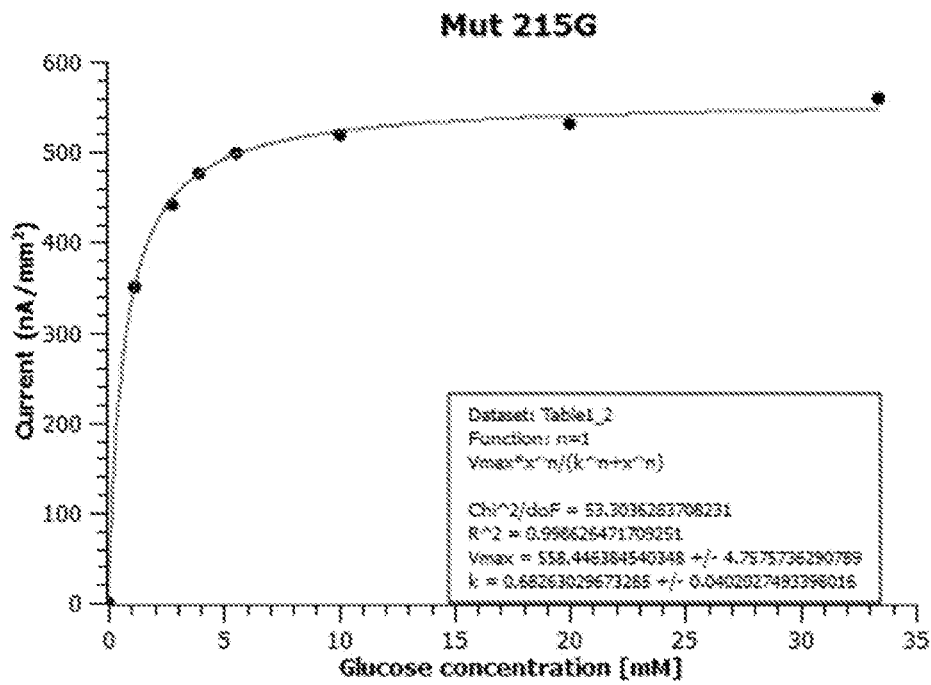

Exemplary embodiments of the compositions of the present invention are shown in FIGS. 19A-B. FIG. 19A shows electrochemical data representing the current response of the biosensor comprising of FAD-GDHα N215G to various glucose concentrations (shown as a square) and the linear fit across the data range is represented by the $R^2$ value. FIG. 19B shows the non-linear fit of the data shown in FIG. 19A, from which $K_m$ (k) and $V_{max}$ have been calculated.

Figure 20A:
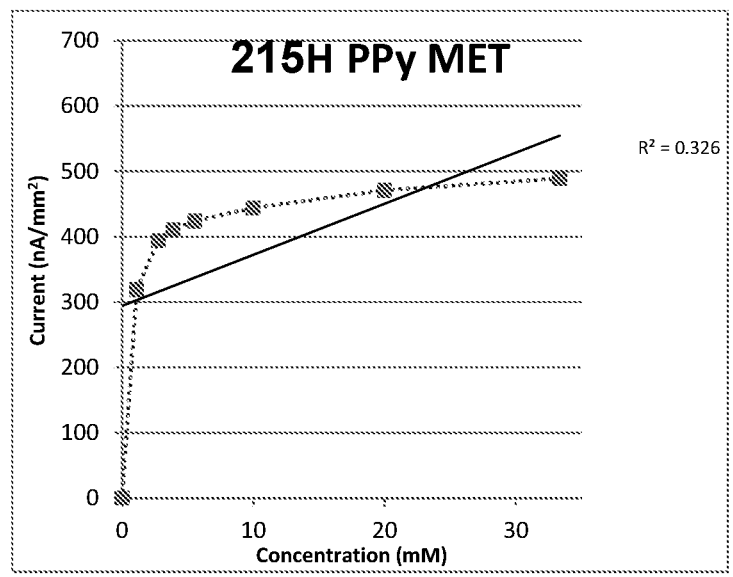
FIGS. 20A-B show some aspects of some embodiments of the present invention.
Figure 20B:
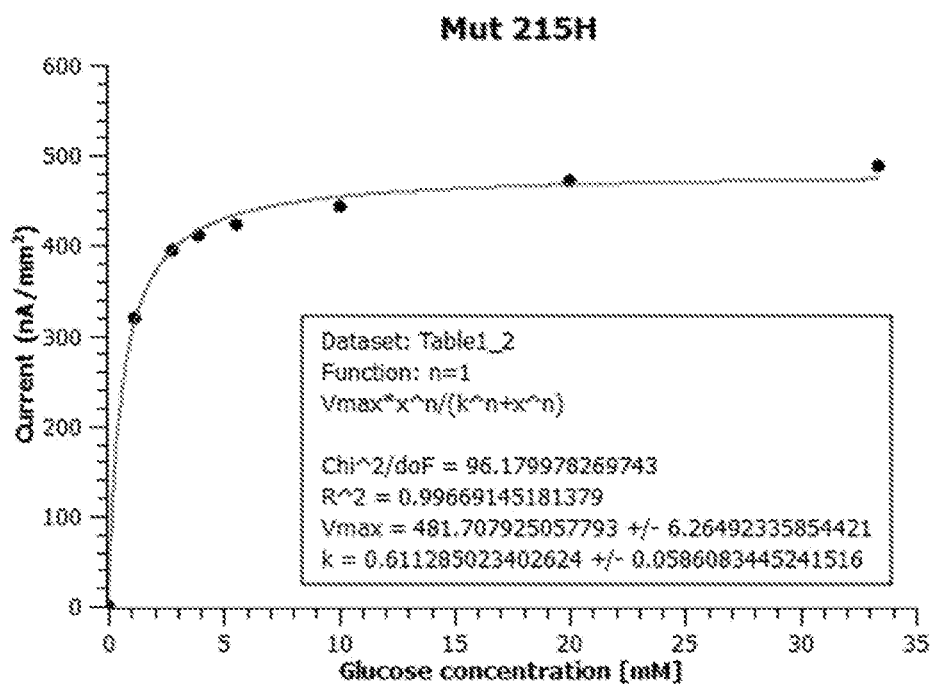

Exemplary embodiments of the compositions of the present invention are shown in FIGS. 20A-B. FIG. 20A shows electrochemical data representing the current response of the biosensor comprising of FAD-GDHα N215H to various glucose concentrations (shown as a square) and the linear fit across the data range is represented by the $R^2$ value. FIG. 20B shows the non-linear fit of the data shown in FIG. 20A, from which $K_m$ (k) and $V_{max}$ have been calculated.

Figure 21A:
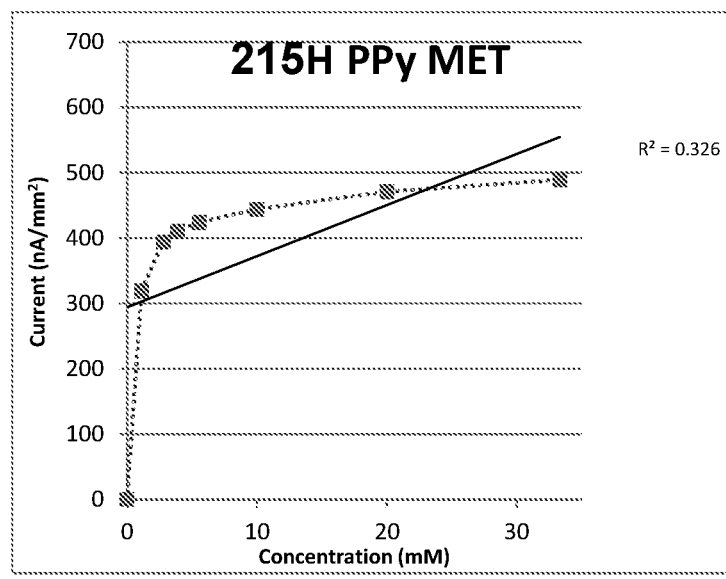
FIGS. 21A-B show some aspects of some embodiments of the present invention.
Figure 21B:
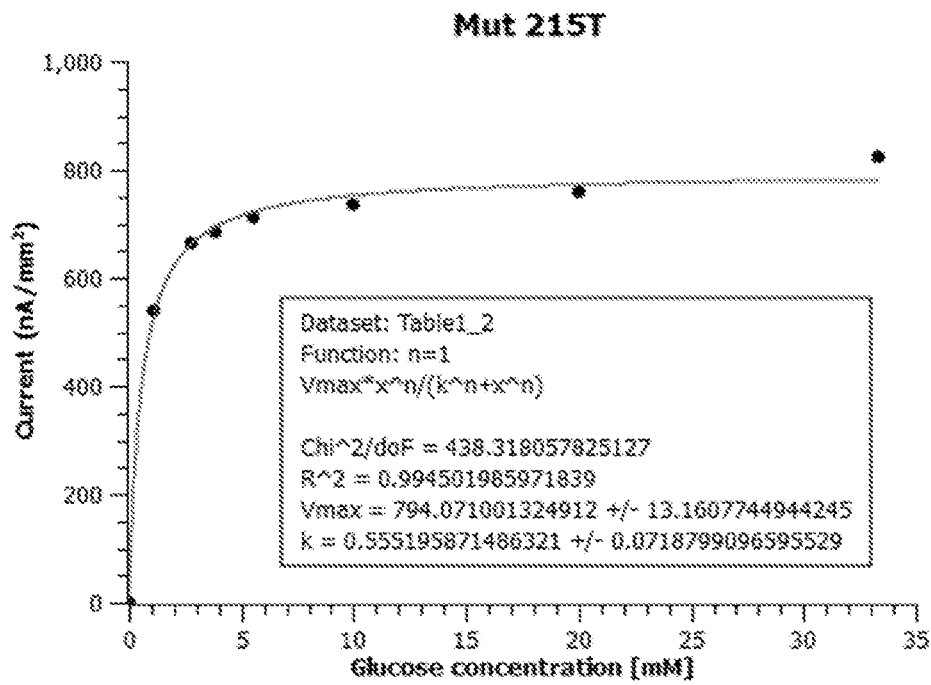

Exemplary embodiments of the compositions of the present invention are shown in FIGS. 21A-B. FIG. 21A shows electrochemical data representing the current response of the biosensor comprising of FAD-GDHα N215T to various glucose concentrations (shown as a square) and the linear fit across the data range is represented by the $R^2$ value. FIG. 21B shows the non-linear fit of the data shown in FIG. 21A, from which $K_m$ (k) and $V_{max}$ have been calculated.

Figure 22A:
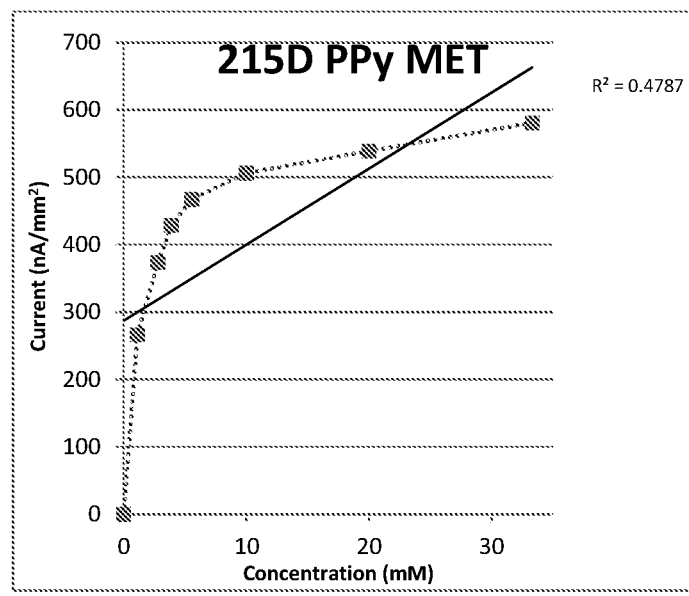
FIGS. 22A-B show some aspects of some embodiments of the present invention.
Figure 22B:
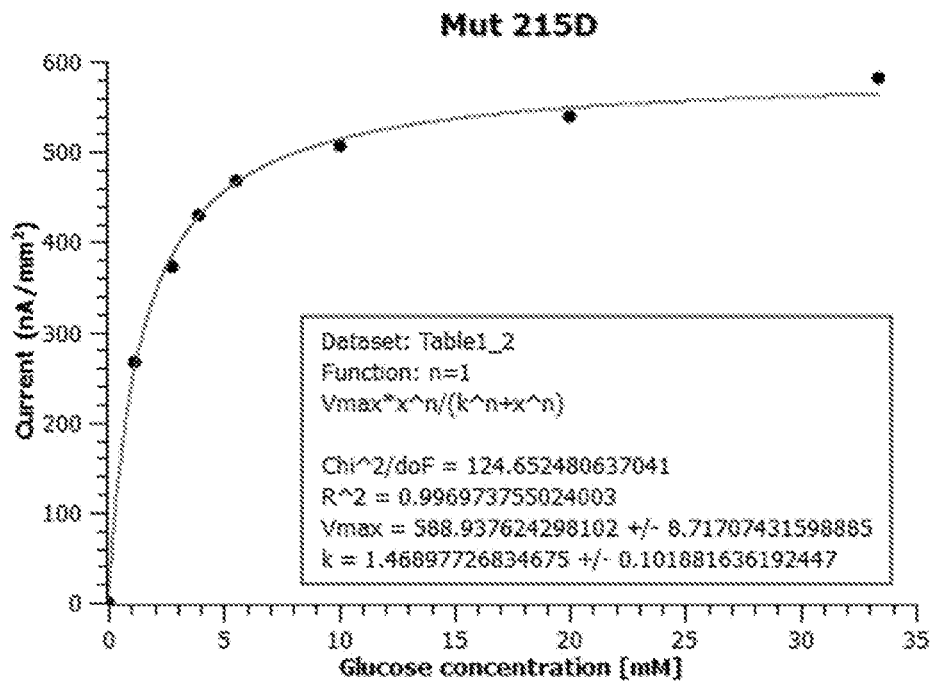

Exemplary embodiments of the compositions of the present invention are shown in FIGS. 22A-B. FIG. 22A shows electrochemical data representing the current response of the biosensor comprising of FAD-GDHα N215D to various glucose concentrations (shown as a square) and the linear fit across the data range is represented by the $R^2$ value. FIG. 22B shows the non-linear fit of the data shown in FIG. 22A, from which $K_m$ (k) and $V_{max}$ have been calculated.

Figure 23A:
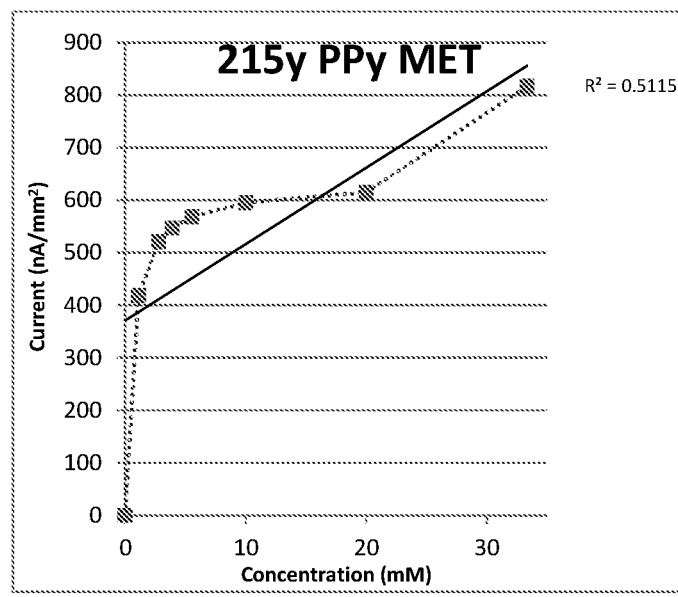
FIGS. 23A-B show some aspects of some embodiments of the present invention.
Figure 23B:
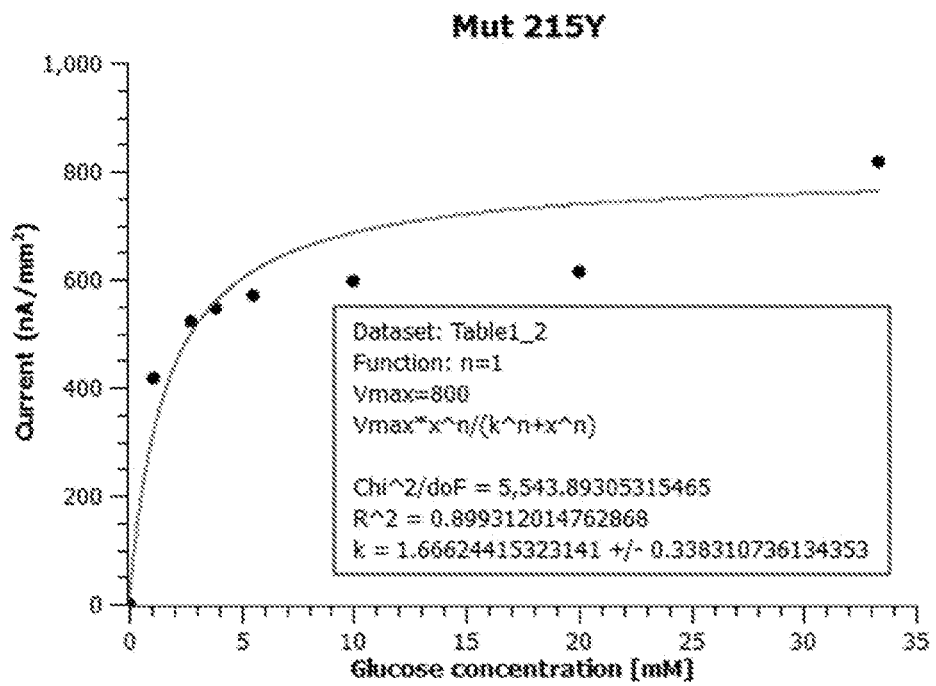

Exemplary embodiments of the compositions of the present invention are shown in FIGS. 23A-B. FIG. 23A shows electrochemical data representing the current response of the biosensor comprising of FAD-GDHα N215Y to various glucose concentrations (shown as a square) and the linear fit across the data range is represented by the $R^2$ value. FIG. 23B shows the non-linear fit of the data shown in FIG. 23A, from which $K_m$ (k) and $V_{max}$ have been calculated.

Figure 24A:
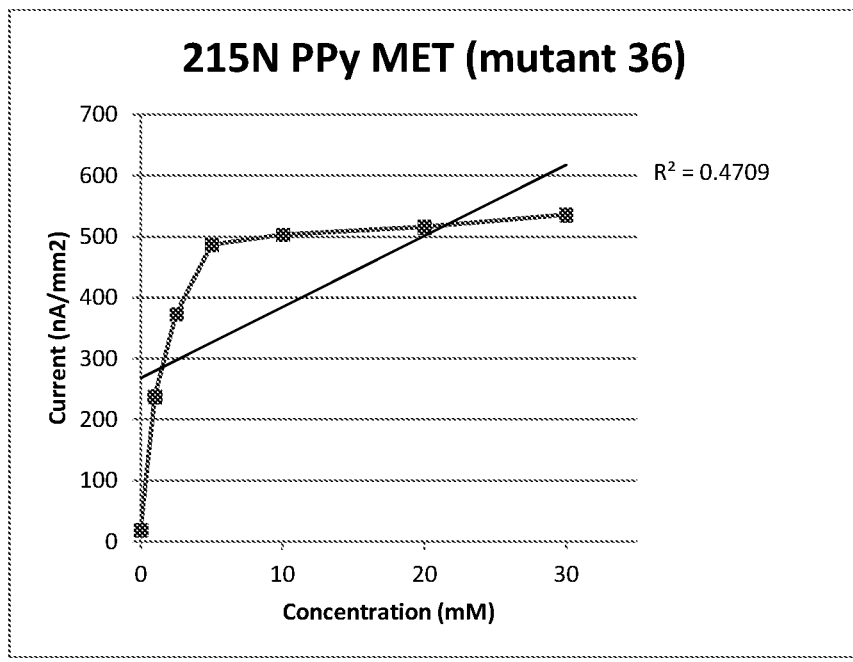
FIGS. 24A-B show some aspects of some embodiments of the present invention.
Figure 24B:
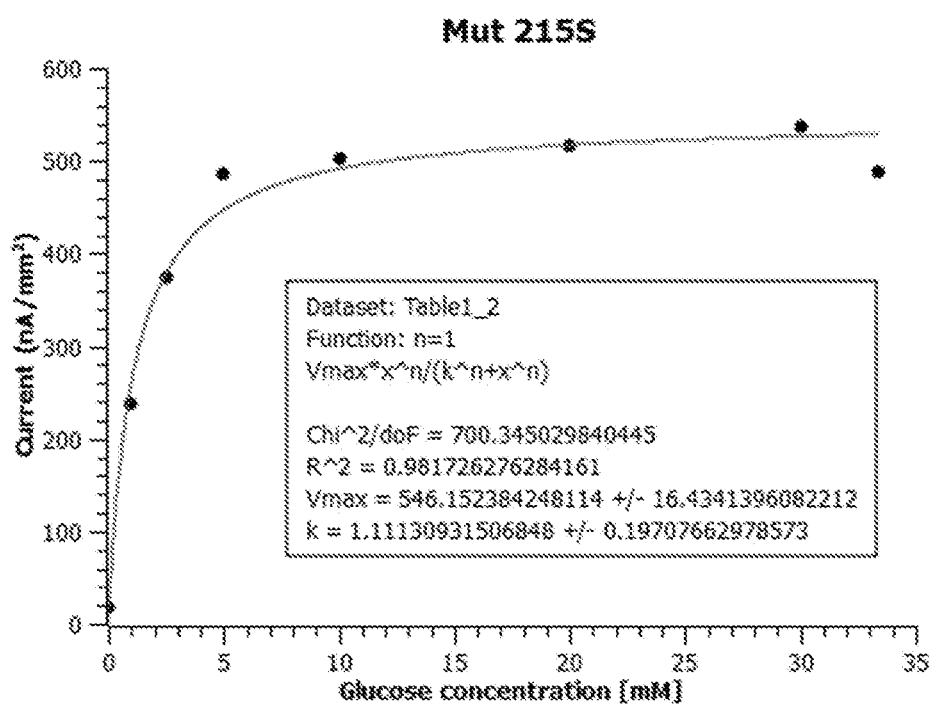

Exemplary embodiments of the compositions of the present invention are shown in FIGS. 24A-B. FIG. 24A shows electrochemical data representing the current response of the biosensor comprising of FAD-GDHα N215S to various glucose concentrations (shown as a square) and the linear fit across the data range is represented by the $R^2$ value. FIG. 24B shows the non-linear fit of the data shown in FIG. 24A, from which $K_m$ (k) and $V_{max}$ have been calculated.

Exemplary embodiments showing electrochemistry data in connection with the wild type FAD-GDHα protein are shown in FIG. 25.

Exemplary embodiments are shown in a table listing electrochemistry data of the composition of the present invention in FIG. 26. Mutations in position 406 provide improved linearity over the entire range of physiological range: F406-S/C/T/V/Y/N/P/L/G/A/I/D/E. Mutations in position 215 provide improved linearity over the entire range of physiological range: N215-G/H/T/D/Y/S.

Exemplary embodiments of the composition of the present invention are shown in FIG. 27. Mutations in position 406 that provide improved selectivity of glucose: F406-S/C/T/M/V/Y/N/P/L/G/Q/A/I/D/H/E. F406W provides an example of a substitution that reduces the enzyme selectivity towards glucose.

FIG. 34A shows an exemplary embodiment of the present invention, showing electrochemistry data of FAD-GDHα (N177S, N215S, F353L, F406L) to varying concentrations of glucose (shown as a rhombus), using screen-printed electrodes according to some embodiments of the present invention, where the mutant FAD-GDH protein is immobilized with polypyrrole, and benzoquinone is used as a mediator to obtain a single measurement. FIG. 34B shows the non-linear fit (red line) of the data represented in FIG. 34A. $V_{max}$ refers to the maximum current flux, K refers to the apparent $K_m$ value extracted from the Michaelis menten equation.

FIG. 35A shows an exemplary embodiment of the present invention, showing electrochemistry data of FAD-GDHα (N177S, N215S, F353L, F406L) to varying concentrations of glucose (shown as a rhombus), using screen-printed electrodes according to some embodiments of the present invention, where the mutant FAD-GDH protein is immobilized with polypyrrole, to obtain a single measurement via direct electron transfer. FIG. 35B shows the non-linear fit (red line) of the data represented in FIG. 35A. $V_{max}$ refers to the maximum current flux, K refers to the apparent $K_m$ value extracted from the Michaelis menten equation.

FIG. 36A shows an exemplary embodiment of the present invention, showing electrochemistry data of FAD-GDHα (N177S, N215S, F353L, F406L) to varying concentrations of glucose (shown as a rhombus), using screen-printed electrodes according to some embodiments of the present invention, where the mutant FAD-GDH protein is immobilized with PEDOT, to obtain a single measurement via direct electron transfer. FIG. 36B shows the non-linear fit (red line) of the data represented in FIG. 36A. $V_{max}$ refers to the maximum current flux, K refers to the apparent $K_m$ value extracted from the Michaelis menten equation.

FIG. 37A shows an exemplary embodiment of the present invention, showing electrochemistry data of FAD-GDHα (N177S, N215S, F353L, F406L) to varying concentrations of glucose (shown as a rhombus), using screen-printed electrodes according to some embodiments of the present invention, where the mutant FAD-GDH protein is immobilized with graphene oxide, to obtain a single measurement via direct electron transfer. FIG. 37B shows the non-linear fit (red line) of the data represented in FIG. 37A. $V_{max}$ refers to the maximum current flux, K refers to the apparent $K_m$ value extracted from the Michaelis menten equation.

FIGS. 38A and 38B shows an exemplary embodiment of the present invention, showing electrochemistry data of FAD-GDHα (N177S, N215S, F353L, F406L), using an electrode according to some embodiments of the present invention configured to measure glucose levels continuously, for 20 hrs (FIG. 38A), or 64 hr (FIG. 38B). In this the mutant FAD-GDH protein is immobilized with polypyrrole, to obtain a single measurement via direct electron transfer.

FIG. 39 shows an exemplary embodiment of the present invention, showing electrochemistry data of FAD-GDHα (N177S, N215S, F353L, F406L), using an electrode according to some embodiments of the present invention configured to measure glucose levels continuously, for 20 hrs. In this embodiment, the mutant FAD-GDH protein is immobilized with PEDOT, to obtain a single measurement via direct electron transfer FIG. 40 shows a table of electrochemistry data of the embodiments of the electrodes of the present invention.

Exemplary compositions comprising electrodes according to some embodiments of the present invention are shown in FIGS. 39 and 40. Mutations at positions 177, 215, 353, and 406 provide improved linearity, selectivity and detectable current via direct electron transfer over the entire physiological range. Further, the electrodes according to some embodiments of the present invention are capable of measuring glucose for up to 64 hours.

In some embodiments, the protein of the present invention can be linked to an epitope tag, e.g., but not limited to, a HIS tag, a 6×HIS tag, a maltose binding protein tag, a green fluorescent protein tag, a glutathione-s-transferase tag, a streptavidin tag, etc. The epitope tag can be separated from the protein by using a linker having, e.g., 1-n amino acids in length.

Examples: Mutated FAD-GDH, Alpha Subunit (α), Strain *B. cepacia*

Examples of mutated FAD-GDHα proteins are disclosed in International Application Serial No. PCT/US2015/64125, entitled "Compositions and Methods for Measuring Blood Glucose Levels", filed on Dec. 4, 2015.

Example 1

FAD-GDHα was mutated to include the following point mutation: N215D as shown in SEQ ID NO: 105.

Example 2

FAD-GDHα was mutated to include the following point mutation: N215G as shown in SEQ ID NO: 106.

Example 3

FAD-GDHα was mutated to include the following point mutation: N215H as shown in SEQ ID NO: 107.

Example 4

FAD-GDHα was mutated to include the following point mutation: N215T as shown in SEQ ID NO: 108.

Example 5

FAD-GDHα was mutated to include the following point mutation: N215Y as shown in SEQ ID NO: 109.

Example 6

*B. sepacia* FAD-GDHα was mutated to include the following point mutation: N177S, N215S, F353L, F406L, as shown in SEQ ID NO: 110.

Example 7

*B. lata* FAD-GDHα was mutated to include the following point mutation: N177S, N215S, F353L, F406L, as shown in SEQ ID NO: 111.

Example 8

*B. lata* FAD-GDHα was mutated to include the following point mutation: N215S, as shown in SEQ ID NO: 112.

Example 9

*B. lata* FAD-GDHα was mutated to include the following point mutation: N215T, as shown in SEQ ID NO: 113.

Example 10

*B. cepacia* FAD-GDHα was mutated to include the following point mutation: N177S, as shown in SEQ ID NO: 114.

Example 11

*B. lata* FAD-GDHα was mutated to include the following point mutation: N177S, as shown in SEQ ID NO: 115.

Example 12

*B. cepacia* FAD-GDHα was mutated to include the following point mutation: F353L, as shown in SEQ ID NO: 116.

Example 13

*B. lata* FAD-GDHα was mutated to include the following point mutation: F353L, as shown in SEQ ID NO: 117.

Example 14

*B. cepacia* FAD-GDHα was mutated to include the following point mutation: N177S, F406L, as shown in SEQ ID NO: 118.

Example 15

*B. lata* FAD-GDHα was mutated to include the following point mutation: N177S, F406L, as shown in SEQ ID NO: 119.

Example 16

*B. sepacia* FAD-GDHα was mutated to include the following point mutation: F353L, F406L, as shown in SEQ ID NO: 120.

Example 17

*B. lata* FAD-GDHα was mutated to include the following point mutation: F353L, F406L, as shown in SEQ ID NO: 121.

Example 18

*B. sepacia* FAD-GDHα was mutated to include the following point mutation: N215S, F406L, as shown in SEQ ID NO: 122.

Example 19

*B. lata* FAD-GDHα was mutated to include the following point mutation: N215S, F406L, as shown in SEQ ID NO: 123.

Example 20

*B. sepacia* FAD-GDHα was mutated to include the following point mutation: N177S, F353L, F406L, as shown in SEQ ID NO: 124.

Example 21

*B. lata* FAD-GDHα was mutated to include the following point mutation: N177S, F353L, F406L, as shown in SEQ ID NO: 125.

Example 22

*B. sepacia* FAD-GDHα was mutated to include the following point mutation: N177S, N215S, F406L, as shown in SEQ ID NO: 126.

Example 23

*B. lata* FAD-GDHα was mutated to include the following point mutation: N177S, N215S, F406L, as shown in SEQ ID NO: 127.

Example 24

*B. sepacia* FAD-GDHα was mutated to include the following point mutation: N215S, F353L, F406L, as shown in SEQ ID NO: 128.

Example 25

*B. lata* FAD-GDHα was mutated to include the following point mutation: N215S, F353L, F406L, as shown in SEQ ID NO: 129.

The proteins described in Examples 1-25 were generated according to the methods described in International Application Serial No. PCT/US2015/64125, entitled "Compositions and Methods for Measuring Blood Glucose Levels", filed on Dec. 4, 2015.

TABLE 2

Protein sequences of FAD-GDHγα from *B. cepacia* (SEQ ID NO: 1, 3-29) and *B. lata* (SEQ ID NO: 2) and DNA sequences of primers used for random mutagenesis via error prone PCR. Each protein sequence ends in a removable 6x-His tag.

| SEQ ID | Sequence |
| --- | --- |
| SEQ ID NO: 1 | Protein sequence ORF2 (FADα) - *B. cepacia* Wild type<br>MADTDTQKADVVVVGSGVAGATVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCFHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH* |
| SEQ ID NO: 2 | Protein sequence ORF2 (FADα) - *B. lata* Wild type<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCFHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH |
| SEQ ID NO: 3 | Protein sequence ORF2 (FADα) - *B. cepacia* mutant<br>MADTDTQKADVVVVGSGVAGAIVAHQLAMAGKAVILLEAGPRTPRWE<br>IVERFRNQPDKMDFMAPYPSSWAPHPEYGPPNDYLILKGEHKFNSQYIR<br>AVGGTTWHWAASAWRFIPNDFKMKSVYGVGRDWPIQYDDLEPYYQR<br>AEEELGVWGPGPEEDLYSPRKQPYPMPPLPLSFNEQTIKTALNNYDPKF<br>HVVTEPVARNSRPYDGRPTCCGNNNCMPICPIGAMYNGIVHVEKAERA<br>GAKLIENAVVYKLETGPDKRIVAALYKDKTGAEHRVEGKYFVLAANGI<br>ETPKILLMSANRDFPNGVANSSDMVGRNLMDHPGTGVSFYASEKLWPG<br>RGPQEMTSLVGFRDGPFRATEAAKKIHLSNLSRIDQETQKIFKAGKLMK<br>PDELDAQIRDRSARYVQFDCFHEILPQPENRIVPSKTADAIGIPRPEITYA<br>IDDYVKRGAAHIREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 4 | Protein sequence ORF2 (FADα) - *B. cepacia* mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY |

TABLE 2-continued

Protein sequences of FAD-GDHγα from *B. cepacia* (SEQ ID NO: 1, 3-29) and *B. lata* (SEQ ID NO: 2) and DNA sequences of primers used for random mutagenesis via error prone PCR. Each protein sequence ends in a removable 6x-His tag.

| SEQ ID | Sequence |
|---|---|
| | IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLFNLSRIDQETQKIFKAGKLMK<br>PDELDAQIRDRSARYVQFDCFHEILPQPENRIVPNKTATDAIGIPRPEITY<br>AIDDYVKRGAAHTREVYATAAKVLGGTDVVFNDEFAPNNHITGSTIMG<br>ADARDSVVDKDCRTFDHPNLFISSSATMPTVGTVNVTLTIAALALRMSD<br>TLKKEVGSGSGHHHHHH |
| SEQ ID NO: 5 | Protein sequence ORF2 (FADα) - *B. cepacia* mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCFHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 6 | Protein sequence ORF2 (FADα) - *B. cepacia* mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCFHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVALTIAALALRMSDT<br>LKKEVGSGSGHHHHHH |
| SEQ ID NO: 7 | Protein sequence ORF2 (FADα) - *B. cepacia* mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGAANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCFHEILPRPENCIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 8 | Protein sequence ORF2 (FADα) - *B. cepacia* mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLTDHPGTGVSFYASEKLWPG<br>RGPQEMTSLIGFRDGPFRATEAAKKIHLSNLSHIDQETQKIFKAGKLMKP<br>DELDAQIRDRSARYVQFDCFHEILPQPENRIVPSKTATDAIGIPRPEITYAI<br>DDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 9 | Protein sequence ORF2 (FADα) - *B. cepacia* F406L mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER |

TABLE 2-continued

Protein sequences of FAD-GDHγα from *B. cepacia* (SEQ ID NO: 1, 3-29) and *B. lata* (SEQ ID NO: 2) and DNA sequences of primers used for random mutagenesis via error prone PCR. Each protein sequence ends in a removable 6x-His tag.

| SEQ ID | Sequence |
|---|---|
| | AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCLHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 10 | Protein sequence ORF2 (FADα) - *B. cepacia* F406D mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCDHEILPQPENRIVPSKTATDAIGIPRPEITY<br>AIDDYVKRGAAHTREVYATAAKVLGGTDVVFNDEFAPNNHITGSTIMG<br>ADARDSVVDKDCRTFDHPNLFISSSATMPTVGTVNVTLTIAALALRMSD<br>TLKKEVGSGSGHHHHHH |
| SEQ ID NO: 11 | Protein sequence ORF2 (FADα) - *B. cepacia* F406H mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCHHEILPQPENRIVPSKTATDAIGIPRPEITY<br>AIDDYVKRGAAHTREVYATAAKVLGGTDVVFNDEFAPNNHITGSTIMG<br>ADARDSVVDKDCRTFDHPNLFISSSATMPTVGTVNVTLTIAALALRMSD<br>TLKKEVGSGSGHHHHHH |
| SEQ ID NO: 12 | Protein sequence ORF2 (FADα) - *B. cepacia* F406M mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCMHEILPQPENRIVPSKTATDAIGIPRPEITY<br>AIDDYVKRGAAHTREVYATAAKVLGGTDVVFNDEFAPNNHITGSTIMG<br>ADARDSVVDKDCRTFDHPNLFISSSATMPTVGTVNVTLTIAALALRMSD<br>TLKKEVGSGSGHHHHHH |
| SEQ ID NO: 13 | Protein sequence ORF2 (FADα) - *B. cepacia* F406E mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCEHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 14 | Protein sequence ORF2 (FADα) - *B. cepacia* F406S mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK |

TABLE 2-continued

Protein sequences of FAD-GDHγα from B. cepacia (SEQ ID NO: 1, 3-29) and B. lata (SEQ ID NO: 2) and DNA sequences of primers used for random mutagenesis via error prone PCR. Each protein sequence ends in a removable 6x-His tag.

| SEQ ID | Sequence |
|---|---|
| | PDELDAQIRDRSARYVQFDCSHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 15 | Protein sequence ORF2 (FADα) - B. cepacia F406T mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCTHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 16 | Protein sequence ORF2 (FADα) - B. cepacia F406Y mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCYHEILPQPENRIVPSKTATDAIGIPRPEITY<br>AIDDYVKRGAAHTREVYATAAKVLGGTDVVFNDEFAPNNHITGSTIMG<br>ADARDSVVDKDCRTFDHPNLFISSSATMPTVGTVNVTLTIAALALRMSD<br>TLKKEVGSGSGHHHHHH |
| SEQ ID NO: 17 | Protein sequence ORF2 (FADα) - B. cepacia F406N mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCNHEILPQPENRIVPSKTATDAIGIPRPEITY<br>AIDDYVKRGAAHTREVYATAAKVLGGTDVVFNDEFAPNNHITGSTIMG<br>ADARDSVVDKDCRTFDHPNLFISSSATMPTVGTVNVTLTIAALALRMSD<br>TLKKEVGSGSGHHHHHH |
| SEQ ID NO: 18 | Protein sequence ORF2 (FADα) - B. cepacia F406Q mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCQHEILPQPENRIVPSKTATDAIGIPRPEITY<br>AIDDYVKRGAAHTREVYATAAKVLGGTDVVFNDEFAPNNHITGSTIMG<br>ADARDSVVDKDCRTFDHPNLFISSSATMPTVGTVNVTLTIAALALRMSD<br>TLKKEVGSGSGHHHHHH |
| SEQ ID NO: 19 | Protein sequence ORF2 (FADα) - B. cepacia F406C mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCCCHEILPQPENRIVPSKTATDAIGIPRPEITY |

TABLE 2-continued

Protein sequences of FAD-GDHγα from B. cepacia (SEQ ID NO: 1, 3-29) and B. lata (SEQ ID NO: 2) and DNA sequences of primers used for random mutagenesis via error prone PCR. Each protein sequence ends in a removable 6x-His tag.

| SEQ ID | Sequence |
| --- | --- |
| | AIDDYVKRGAAHTREVYATAAKVLGGTDVVFNDEFAPNNHITGSTIMG<br>ADARDSVVDKDCRTFDHPNLFISSSATMPTVGTVNVTLTIAALALRMSD<br>TLKKEVGSGSGHHHHHH |
| SEQ ID NO: 20 | Protein sequence ORF2 (FADα) - B. cepacia F406G mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCGHEILPQPENRIVPSKTATDAIGIPRPEITY<br>AIDDYVKRGAAHTREVYATAAKVLGGTDVVFNDEFAPNNHITGSTIMG<br>ADARDSVVDKDCRTFDHPNLFISSSATMPTVGTVNVTLTIAALALRMSD<br>TLKKEVGSGSGHHHHHH |
| SEQ ID NO: 21 | Protein sequence ORF2 (FADα) - B. cepacia F406P mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCPHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 22 | Protein sequence ORF2 (FADα) - B. cepacia F406A mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCAHEILPQPENRIVPSKTATDAIGIPRPEITY<br>AIDDYVKRGAAHTREVYATAAKVLGGTDVVFNDEFAPNNHITGSTIMG<br>ADARDSVVDKDCRTFDHPNLFISSSATMPTVGTVNVTLTIAALALRMSD<br>TLKKEVGSGSGHHHHHH |
| SEQ ID NO: 23 | Protein sequence ORF2 (FADα) - B. cepacia F406V mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCVHEILPQPENRIVPSKTATDAIGIPRPEITY<br>AIDDYVKRGAAHTREVYATAAKVLGGTDVVFNDEFAPNNHITGSTIMG<br>ADARDSVVDKDCRTFDHPNLFISSSATMPTVGTVNVTLTIAALALRMSD<br>TLKKEVGSGSGHHHHHH |
| SEQ ID NO: 24 | Protein sequence ORF2 (FADα) - B. cepacia F406I mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCIHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |

TABLE 2-continued

Protein sequences of FAD-GDHγα from B. cepacia (SEQ ID NO: 1, 3-29) and B. lata (SEQ ID NO: 2) and DNA sequences of primers used for random mutagenesis via error prone PCR. Each protein sequence ends in a removable 6x-His tag.

| SEQ ID | Sequence |
| --- | --- |

SEQ ID NO: 25 Protein sequence ORF2 (FADα) - B. cepacia F406W mutant
MADTDTQKADVVVVGSGVAGAIVAHQLAMAGKAVILLEAGPRMPRW
EIVERFRNQPDKMDFMAPYPSSPWAPHPEYGPPNDYLILKGEHKFNSQY
IRAVGGTTWHWAASAWRFIPNDFKMKSVYGVGRDWPIQYDDLEPYYQ
RAEEELGVWGPGPEEDLYSPRKQPYPMPPLPLSFNEQTIKTALNNYDPK
FHVVTEPVARNSRPYDGRPTCCGNNNCMPICPIGAMYNGIVHVEKAER
AGAKLIENAVVYKLETGPDKRIVAALYKDKTGAEHRVEGKYFVLAANG
IETPKILLMSANRDFPNGVANSSDMVGRNLMDHPGTGVSFYASEKLWP
GRGPQEMTSLIGFRDGPFRATEAAKKIHLSNLSRIDQETQKIFKAGKLMK
PDELDAQIRDRSARYVQFDCWHEILPQPENRIVPSKTATDAIGIPRPEITY
AIDDYVKRGAAHTREVYATAAKVLGGTDVVFNDEFAPNNHITGSTIMG
ADARDSVVDKDCRTFDHPNLFISSSATMPTVGTVNVTLTIAALALRMSD
TLKKEVGSGSGHHHHHH SEQ ID NO: 26 Protein sequence ORF2 (FADα) - B. cepacia N474H mutant
MADTDTQKADVVVVGSGVAGAIVAHQLAMAGKAVILLEAGPRMPRW
EIVERFRNQPDKMDFMAPYPSSPWAPHPEYGPPNDYLILKGEHKFNSQY
IRAVGGTTWHWAASAWRFIPNDFKMKSVYGVGRDWPIQYDDLEPYYQ
RAEEELGVWGPGPEEDLYSPRKQPYPMPPLPLSFNEQTIKTALNNYDPK
FHVVTEPVARNSRPYDGRPTCCGNNNCMPICPIGAMYNGIVHVEKAER
AGAKLIENAVVYKLETGPDKRIVAALYKDKTGAEHRVEGKYFVLAANG
IETPKILLMSANRDFPNGVANSSDMVGRNLMDHPGTGVSFYASEKLWP
GRGPQEMTSLIGFRDGPFRATEAAKKIHLSNLSRIDQETQKIFKAGKLMK
PDELDAQIRDRSARYVQFDCFHEILPQPENRIVPSKTATDAIGIPRPEITYA
IDDYVKRGAAHTREVYATAAKVLGGTDVVFNDEFAPHNHITGSTIMGA
DARDSVVDKDCRTFDHPNLFISSSATMPTVGTVNVTLTIAALALRMSDT
LKKEVGSGSGHHHHHH SEQ ID NO: 27 Protein sequence ORF2 (FADα) - B. cepacia N474L mutant
MADTDTQKADVVVVGSGVAGAIVAHQLAMAGKAVILLEAGPRMPRW
EIVERFRNQPDKMDFMAPYPSSPWAPHPEYGPPNDYLILKGEHKFNSQY
IRAVGGTTWHWAASAWRFIPNDFKMKSVYGVGRDWPIQYDDLEPYYQ
RAEEELGVWGPGPEEDLYSPRKQPYPMPPLPLSFNEQTIKTALNNYDPK
FHVVTEPVARNSRPYDGRPTCCGNNNCMPICPIGAMYNGIVHVEKAER
AGAKLIENAVVYKLETGPDKRIVAALYKDKTGAEHRVEGKYFVLAANG
IETPKILLMSANRDFPNGVANSSDMVGRNLMDHPGTGVSFYASEKLWP
GRGPQEMTSLIGFRDGPFRATEAAKKIHLSNLSRIDQETQKIFKAGKLMK
PDELDAQIRDRSARYVQFDCFHEILPQPENRIVPSKTATDAIGIPRPEITYA
IDDYVKRGAAHTREVYATAAKVLGGTDVVFNDEFAPLNHITGSTIMGA
DARDSVVDKDCRTFDHPNLFISSSATMPTVGTVNVTLTIAALALRMSDT
LKKEVGSGSGHHHHHH SEQ ID NO: 28 Protein sequence ORF2 (FADα) - B. cepacia N474S mutant
MADTDTQKADVVVVGSGVAGAIVAHQLAMAGKAVILLEAGPRMPRW
EIVERFRNQPDKMDFMAPYPSSPWAPHPEYGPPNDYLILKGEHKFNSQY
IRAVGGTTWHWAASAWRFIPNDFKMKSVYGVGRDWPIQYDDLEPYYQ
RAEEELGVWGPGPEEDLYSPRKQPYPMPPLPLSFNEQTIKTALNNYDPK
FHVVTEPVARNSRPYDGRPTCCGNNNCMPICPIGAMYNGIVHVEKAER
AGAKLIENAVVYKLETGPDKRIVAALYKDKTGAEHRVEGKYFVLAANG
IETPKILLMSANRDFPNGVANSSDMVGRNLMDHPGTGVSFYASEKLWP
GRGPQEMTSLIGFRDGPFRATEAAKKIHLSNLSRIDQETQKIFKAGKLMK
PDELDAQIRDRSARYVQFDCFHEILPQPENRIVPSKTATDAIGIPRPEITYA
IDDYVKRGAAHTREVYATAAKVLGGTDVVFNDEFAPSNHITGSTIMGA
DARDSVVDKDCRTFDHPNLFISSSATMPTVGTVNVTLTIAALALRMSDT
LKKEVGSGSGHHHHHH SEQ ID NO: 29 Protein sequence ORF2 (FADα) - B. cepacia N474V mutant
MADTDTQKADVVVVGSGVAGAIVAHQLAMAGKAVILLEAGPRMPRW
EIVERFRNQPDKMDFMAPYPSSPWAPHPEYGPPNDYLILKGEHKFNSQY
IRAVGGTTWHWAASAWRFIPNDFKMKSVYGVGRDWPIQYDDLEPYYQ
RAEEELGVWGPGPEEDLYSPRKQPYPMPPLPLSFNEQTIKTALNNYDPK
FHVVTEPVARNSRPYDGRPTCCGNNNCMPICPIGAMYNGIVHVEKAER
AGAKLIENAVVYKLETGPDKRIVAALYKDKTGAEHRVEGKYFVLAANG
IETPKILLMSANRDFPNGVANSSDMVGRNLMDHPGTGVSFYASEKLWP
GRGPQEMTSLIGFRDGPFRATEAAKKIHLSNLSRIDQETQKIFKAGKLMK
PDELDAQIRDRSARYVQFDCFHEILPQPENRIVPSKTATDAIGIPRPEITYA
IDDYVKRGAAHTREVYATAAKVLGGTDVVFNDEFAPVNHITGSTIMGA
DARDSVVDKDCRTFDHPNLFISSSATMPTVGTVNVTLTIAALALRMSDT
LKKEVGSGSGHHHHHH

TABLE 2-continued

Protein sequences of FAD-GDHγα from *B. cepacia* (SEQ ID NO: 1, 3-29) and *B. lata* (SEQ ID NO: 2) and DNA sequences of primers used for random mutagenesis via error prone PCR. Each protein sequence ends in a removable 6x-His tag.

| SEQ ID | Sequence |
| --- | --- |
| SEQ ID NO: 30 | Primer used for random mutagenesis via error prone PCR method<br>CCAGGCAAATTCTGTTTTATCAGACC |
| SEQ ID NO: 31 | Primer used for random mutagenesis via error prone PCR method<br>CAAGCTGGAGACCGTTTAAACTC |
| SEQ ID NO: 32 | Primer used for random mutagenesis via error prone PCR method<br>CGCTATTCAGATCCTCTTCTGAGATG |
| SEQ ID NO: 33 | Primer used for random mutagenesis via error prone PCR method<br>GCTTCTGCGTTCTGATTTAATCTG |
| SEQ ID NO: 34 | Primer used for random mutagenesis via error prone PCR method<br>GGTCGTGGTCGGATCCGGTGTGGCAGGTGCTATTGTG |
| SEQ ID NO: 35 | Primer used for random mutagenesis via error prone PCR method<br>CGTTCTTATTGCCCGAATAAACC |
| SEQ ID NO: 36 | Primer used for random mutagenesis via error prone PCR method<br>CGAAGAAGCCCTGATGTTTGG |
| SEQ ID NO: 37 | Primer used for random mutagenesis via error prone PCR method<br>GAAGCATGGTATCTGGGCATTGTTG |

Bold text indicates mutations relative to wild-type within the amino acid sequence

TABLE 3

Protein sequences of FAD-GDHyα from *B. cepacia* (SEQ ID NO: 38, SEQ ID NOs: 40-66) and *B. lata* (SEQ ID NO: 39).

SEQ ID NO: 38 Protein sequence ORF2 (FADα) - *B. cepacia* Wild type
MADTDTQKADVVVVGSGVAGAIVAHQLAMAGKAVILLEAGPRMPRW
EIVERFRNQPDKMDFMAPYPSSPWAPHPEYGPPNDYLILKGEHKFNSQY
IRAVGGTTWHWAASAWRFIPNDFKMKSVYGVGRDWPIQYDDLEPYYQ
RAEEELGVWGPGPEEDLYSPRKQPYPMPPLPLSFNEQTIKTALNNYDPK
FHVVTEPVARNSRPYDGRPTCCGNNNCMPICPIGAMYNGIVHVEKAER
AGAKLIENAVVYKLETGPDKRIVAALYKDKTGAEHRVEGKYFVLAANG
IETPKILLMSANRDFPNGVANSSDMVGRNLMDHPGTGVSFYASEKLWP
GRGPQEMTSLIGFRDGPFRATEAAKKIHLSNLSRIDQETQKIFKAGKLMK
PDELDAQIRDRSARYVQFDCFHEILPQPENRIVPSKTATDAIGIPRPEITYA
IDDYVKRGAAHTREVYATAAKVLGGTDVVFNDEFAPNNHITGSTIMGA
DARDSVVDKDCRTFDHPNLFISSSATMPTVGTVNVTLTIAALALRMSDT
LKKEV SEQ ID NO: 39 Protein sequence ORF2 (FADα) *B. lata* Wild type
MADTDTQKADVVVVGSGVAGAIVAHQLAMAGKSVILLEAGPRMPRWE
IVERFRNQVDKTDFMAPYPSSAWAPHPEYGPPNDYLILKGEHKFNSQYI
RAVGGTTWHWAASAWRFIPNDFKMKTVYGVGRDWPIQYDDIEHYYQR
AEEELGVWGPGPEEDLYSPRKEPYPMPPLPLSFNEQTIKSALNGYDPKFFI
VVTEPVARNSRPYDGRPTCCGNNNCMPICPIGAMYNGIVHVEKAEQAG
AKLIDSAVVYKLETGPDKRITAAVYKDKTGADHRVEGKYFVIAANGIET
PKILLMSANRDFPNGVANSSDMVGRNLMDHPGTGVSFYANEKLWPGR
GPQEMTSLIGFRDGPFRANEAAKKIHLSNMSRINQETQKIFKGGKLMKP
EELDAQIRDRSARFVQFDCFHEILPQPENRIVPSKTATDAVGIPRPEITYAI
DDYVKRGAVHTREVYATAAKVLGGTEVVFNDEFAPNNHITGATIMGA
DARDSVVDKDCRAFDHPNLFISSSSTMPTVGTVNVTLTIAALALRMSDT
LKKEV SEQ ID NO: 40 Protein sequence ORF2 (FADα) - *B. cepacia* mutant
MADTDTQKADVVVVGSGVAGAIVAHQLAMAGKAVILLEAGPRTPRWE
IVERFRNQPDKMDFMAPYPSSWAPHPEYGPPNDYLILKGEHKFNSQYIR
AVGGTTWHWAASAWRFIPNDFKMKSVYGVGRDWPIQYDDLEPYYQR
AEEELGVWGPGPEEDLYSPRKQPYPMPPLPLSFNEQTIKTALNNYDPKF
HVVTEPVARNSRPYDGRPTCCGNNNCMPICPIGAMYNGIVHVEKAERA
GAKLIENAVVYKLETGPDKRIVAALYKDKTGAEHRVEGKYFVLAANGI
ETPKILLMSANRDFPNGVANSSDMVGRNLMDHPGTGVSFYASEKLWPG
RGPQEMTSLVGFRDGPFRATEAAKKIHLSNLSRIDQETQKIFKAGKLMK
PDELDAQIRDRSARYVQFDCFHEILPQPENRIVPSKTATDAIGIPRPEITYA
IDDYVKRGAAHTREVYATAAKVLGGTDVVFNDEFAPNNHITGSTIMGA TABLE 3-continued Protein sequences of FAD-GDHya from *B. cepacia* (SEQ ID NO: 38, SEQ ID NOs: 40-66) and *B. lata* (SEQ ID NO: 39).

```
              DARDSVVDKDCRTFDHPNLFISSSATMPTVGTVNVTLTIAALALRMSDT
              LKKEV

SEQ ID NO: 41 Protein sequence ORF2 (FADα) - B. cepacia mutant
              MADTDTQKADVVVVGSGVAGAIVAHQLAMAGKAVILLEAGPRMPRW
              EIVERFRNQPDKMDFMAPYPSSPWAPHPEYGPPNDYLILKGEHKFNSQY
              IRAVGGTTWHWAASAWRFIPNDFKMKSVYGVGRDWPIQYDDLEPYYQ
              RAEEELGVWGPGPEEDLYSPRKQPYPMPPLPLSFNEQTIKTALNNYDPK
              FHVVTEPVARNSRPYDGRPTCCGNNNCMPICPIGAMYNGIVHVEKAER
              AGAKLIENAVVYKLETGPDKRIVAALYKDKTGAEHRVEGKYFVLAANG
              IETPKILLMSANRDFPNGVANSSDMVGRNLMDHPGTGVSFYASEKLWP
              GRGPQEMTSLIGFRDGPFRATEAAKKIHLFNLSRIDQETQKIFKAGKLMK
              PDELDAQIRDRSARYVQFDCFHEILPQPENRTVPNKTATDATGIPRPEITY
              AIDDYVKRGAAHTREVYATAAKVLGGTDVVFNDEFAPNNHITGSTIMG
              ADARDSVVDKDCRTFDHPNLFISSSATMPTVGTVNVTLTIAALALRMSD
              TLKKEV SEQ ID NO: 42 Protein sequence ORF2 (FADα) - B. cepacia mutant
              MADTDTQKADVVVVGSGVAGAIVAHQLAMAGKAVILLEAGPRMPRW
              EIVERFRNQPDKMDFMAPYPSSPWAPHPEYGPPNDYLILKGEHKFNSQY
              IRAVGGTTWHWAASAWRFIPNDFKMKSVYGVGRDWPIQYDDLEPYYQ
              RAEEELGVWGPGPEEDLYSPRKQPYPMPPLPLSFNEQTIKTALNNYDPK
              FHVVTEPVARNSRPYDGRPTCCGNNNCMPICPIGAMYNGIVHVEKAER
              AGAKLIENAVVYKLETGPDKRIVAALYKDKTGAEHRVEGKYFVLAANG
              IETPKILLMSANRDFPNGVANSSDMVGRNLMDHPGTGVSFYASEKLWP
              GRGPQEMTSLIGFRDGPFRATEAAKKIHLSNLSRIDQETQKIFKAGKLMK
              PDELDAQIRDRSARYVQFDCFHEILPQPENRIVPSKTATDAIGIPRPEITYA
              IDDYVKRGAAHTREVYATAAKVLGGTDVVFNDEFAPNNHITGSTIMGA
              DARDSVVDKDCRTFDHPNLFISSSATMPTVGTVNVTLTIAALALRMSDT
              LKKEV SEQ ID NO: 43 Protein sequence ORF2 (FADα) - B. cepacia mutant
              MADTDTQKADVVVVGSGVAGAIVAHQLAMAGKAVILLEAGPRMPRW
              EIVERFRNQPDKMDFMAPYPSSPWAPHPEYGPPNDYLILKGEHKFNSQY
              IRAVGGTTWHWAASAWRFIPNDFKMKSVYGVGRDWPIQYDDLEPYYQ
              RAEEELGVWGPGPEEDLYSPRKQPYPMPPLPLSFNEQTIKTALNNYDPK
              FHVVTEPVARNSRPYDGRPTCCGNNNCMPICPIGAMYNGIVHVEKAER
              AGAKLIENAVVYKLETGPDKRIVAALYKDKTGAEHRVEGKYFVLAANG
              IETPKILLMSANRDFPNGVANSSDMVGRNLMDHPGTGVSFYASEKLWP
              GRGPQEMTSLIGFRDGPFRATEAAKKIHLSNLSRIDQETQKIFKAGKLMK
              PDELDAQIRDRSARYVQFDCFHEILPQPENRIVPSKTATDAIGIPRPEITYA
              IDDYVKRGAAHTREVYATAAKVLGGTDVVFNDEFAPNNHITGSTIMGA
              DARDSVVDKDCRTFDHPNLFISSSATMPTVGTVNVALTIAALALRMSDT
              LKKEV SEQ ID NO: 44 Protein sequence ORF2 (FADα) - B. cepacia mutant
              MADTDTQKADVVVVGSGVAGAIVAHQLAMAGKAVILLEAGPRMPRW
              EIVERFRNQPDKMDFMAPYPSSPWAPHPEYGPPNDYLILKGEHKFNSQY
              IRAVGGTTWHWAASAWRFIPNDFKMKSVYGVGRDWPIQYDDLEPYYQ
              RAEEELGVWGPGPEEDLYSPRKQPYPMPPLPLSFNEQTIKTALNNYDPK
              FHVVTEPVARNSRPYDGRPTCCGNNNCMPICPIGAMYNGIVHVEKAER
              AGAKLIENAVVYKLETGPDKRIVAALYKDKTGAEHRVEGKYFVLAANG
              IETPKILLMSANRDFPNGAANSSDMVGRNLMDHPGTGVSFYASEKLWP
              GRGPQEMTSLIGFRDGPFRATEAAKKIHLSNLSRIDQETQKIFKAGKLMK
              PDELDAQIRDRSARYVQFDCFHEILPRPENCIVPSKTATDAIGIPRPEITYA
              IDDYVKRGAAHTREVYATAAKVLGGTDVVFNDEFAPNNHITGSTIMGA
              DARDSVVDKDCRTFDHPNLFISSSATMPTVGTVNVTLTIAALALRMSDT
              LKKEV SEQ ID NO: 45 Protein sequence ORF2 (FADα) - B. cepacia mutant
              MADTDTQKADVVVVGSGVAGAIVAHQLAMAGKAVILLEAGPRMPRW
              EIVERFRNQPDKMDFMAPYPSSPWAPHPEYGPPNDYLILKGEHKFNSQY
              IRAVGGTTWHWAASAWRFIPNDFKMKSVYGVGRDWPIQYDDLEPYYQ
              RAEEELGVWGPGPEEDLYSPRKQPYPMPPLPLSFNEQTIKTALNNYDPK
              FHVVTEPVARNSRPYDGRPTCCGNNNCMPICPIGAMYNGIVHVEKAER
              AGAKLIENAVVYKLETGPDKRIVAALYKDKTGAEHRVEGKYFVLAANG
              IETPKILLMSANRDFPNGVANSSDMVGRNLTDHPGTGVSFYASEKLWPG
              RGPQEMTSLIGFRDGPFRATEAAKKIHLSNLSHIDQETQKIFKAGKLMKP
              DELDAQIRDRSARYVQFDCFHEILPQPENRIVPSKTATDAIGIPRPEITYAI
              DDYVKRGAAHTREVYATAAKVLGGTDVVFNDEFAPNNHITGSTIMGA
              DARDSVVDKDCRTFDHPNLFISSSATMPTVGTVNVTLTIAALALRMSDT
              LKKEV SEQ ID NO: 46 Protein sequence ORF2 (FADα) - B. cepacia F406L mutant
              MADTDTQKADVVVVGSGVAGAIVAHQLAMAGKAVILLEAGPRMPRW
              EIVERFRNQPDKMDFMAPYPSSPWAPHPEYGPPNDYLILKGEHKFNSQY
              IRAVGGTTWHWAASAWRFIPNDFKMKSVYGVGRDWPIQYDDLEPYYQ
```

TABLE 3-continued

Protein sequences of FAD-GDHya from *B. cepacia* (SEQ ID NO: 38, SEQ ID NOs: 40-66) and *B. lata* (SEQ ID NO: 39).

```
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCLHEILPQPENRIVPSKTATDAIGIPRPEITYA
                IDDYVKRGAAHTREVYATAAKVLGGTDVVFNDEFAPNNHITGSTIMGA
                DARDSVVDKDCRTFDHPNLFISSSATMPTVGTVNVTLTIAALALRMSDT
                LKKEV
```

SEQ ID NO: 47 Protein sequence ORF2 (FADα) - *B. cepacia* F406D mutant
```
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCDHEILPQPENRIVPSKTATDAIGIPRPEITY
                AIDDYVKRGAAHTREVYATAAKVLGGTDVVFNDEFAPNNHITGSTIMG
                ADARDSVVDKDCRTFDHPNLFISSSATMPTVGTVNVTLTIAALALRMSD
                TLKKEV
```

SEQ ID NO: 48 Protein sequence ORF2 (FADα) - *B. cepacia* F406H mutant
```
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCHHEILPQPENRIVPSKTATDAIGIPRPEITY
                AIDDYVKRGAAHTREVYATAAKVLGGTDVVFNDEFAPNNHITGSTIMG
                ADARDSVVDKDCRTFDHPNLFISSSATMPTVGTVNVTLTIAALALRMSD
                TLKKEV
```

SEQ ID NO: 49 Protein sequence ORF2 (FADα) - *B. cepacia* F406M mutant
```
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCMHEILPQPENRIVPSKTATDAIGIPRPEITY
                AIDDYVKRGAAHTREVYATAAKVLGGTDVVFNDEFAPNNHITGSTIMG
                ADARDSVVDKDCRTFDHPNLFISSSATMPTVGTVNVTLTIAALALRMSD
                TLKKEV
```

SEQ ID NO: 50 Protein sequence ORF2 (FADα) - *B. cepacia* F406E mutant
```
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCEHEILPQPENRIVPSKTATDAIGIPRPEITYA
                IDDYVKRGAAHTREVYATAAKVLGGTDVVFNDEFAPNNHITGSTIMGA
                DARDSVVDKDCRTFDHPNLFISSSATMPTVGTVNVTLTIAALALRMSDT
                LKKEV
```

SEQ ID NO: 51 Protein sequence ORF2 (FADα) - *B. cepacia* F406S mutant
```
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCSHEILPQPENRIVPSKTATDAIGIPRPEITYA
                IDDYVKRGAAHTREVYATAAKVLGGTDVVFNDEFAPNNHITGSTIMGA
```

TABLE 3-continued

Protein sequences of FAD-GDHya from *B. cepacia* (SEQ ID NO: 38, SEQ ID NOs: 40-66) and *B. lata* (SEQ ID NO: 39).

```
                DARDSVVDKDCRTFDHPNLFISSSATMPTVGTVNVTLTIAALALRMSDT
                LKKEV

SEQ ID NO: 52  Protein sequence ORF2 (FADα) - B. cepacia F406T mutant
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCTHEILPQPENRIVPSKTATDAIGIPRPEITYA
                IDDYVKRGAAHTREVYATAAKVLGGTDVVFNDEFAPNNHITGSTIMGA
                DARDSVVDKDCRTFDHPNLFISSSATMPTVGTVNVTLTIAALALRMSDT
                LKKEV SEQ ID NO: 53  Protein sequence ORF2 (FADα) - B. cepacia F406Y mutant
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCYHEILPQPENRIVPSKTATDAIGIPRPEITY
                AIDDYVKRGAAHTREVYATAAKVLGGTDVVFNDEFAPNNHITGSTIMG
                ADARDSVVDKDCRTFDHPNLFISSSATMPTVGTVNVTLTIAALALRMSD
                TLKKEV SEQ ID NO: 54  Protein sequence ORF2 (FADα) - B. cepacia F406N mutant
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCNHEILPQPENRIVPSKTATDAIGIPRPEITY
                AIDDYVKRGAAHTREVYATAAKVLGGTDVVFNDEFAPNNHITGSTIMG
                ADARDSVVDKDCRTFDHPNLFISSSATMPTVGTVNVTLTIAALALRMSD
                TLKKEV SEQ ID NO: 55  Protein sequence ORF2 (FADα) - B. cepacia F406Q mutant
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCQHEILPQPENRIVPSKTATDAIGIPRPEITY
                AIDDYVKRGAAHTREVYATAAKVLGGTDVVFNDEFAPNNHITGSTIMG
                ADARDSVVDKDCRTFDHPNLFISSSATMPTVGTVNVTLTIAALALRMSD
                TLKKEV SEQ ID NO: 56  Protein sequence ORF2 (FADα) - B. cepacia F406C mutant
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCCHEILPQPENRIVPSKTATDAIGIPRPEITY
                AIDDYVKRGAAHTREVYATAAKVLGGTDVVFNDEFAPNNHITGSTIMG
                ADARDSVVDKDCRTFDHPNLFISSSATMPTVGTVNVTLTIAALALRMSD
                TLKKEV SEQ ID NO: 57  Protein sequence ORF2 (FADα) - B. cepacia F406G mutant
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
```

TABLE 3-continued

Protein sequences of FAD-GDHya from *B. cepacia* (SEQ ID NO: 38, SEQ ID NOs: 40-66) and *B. lata* (SEQ ID NO: 39).

```
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCGHEILPQPENRIVPSKTATDAIGIPRPEITY
                AIDDYVKRGAAHTREVYATAAKVLGGTDVVFNDEFAPNNHITGSTIMG
                ADARDSVVDKDCRTFDHPNLFISSSATMPTVGTVNVTLTIAALALRMSD
                TLKKEV
```

SEQ ID NO: 58 Protein sequence ORF2 (FADα) - *B. cepacia* F406P mutant
```
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCPHEILPQPENRIVPSKTATDAIGIPRPEITYA
                IDDYVKRGAAHTREVYATAAKVLGGTDVVFNDEFAPNNHITGSTIMGA
                DARDSVVDKDCRTFDHPNLFISSSATMPTVGTVNVTLTIAALALRMSDT
                LKKEV
```

SEQ ID NO: 59 Protein sequence ORF2 (FADα) - *B. cepacia* F406A mutant
```
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCAHEILPQPENRIVPSKTATDAIGIPRPEITY
                AIDDYVKRGAAHTREVYATAAKVLGGTDVVFNDEFAPNNHITGSTIMG
                ADARDSVVDKDCRTFDHPNLFISSSATMPTVGTVNVTLTIAALALRMSD
                TLKKEV
```

SEQ ID NO: 60 Protein sequence ORF2 (FADα) - *B. cepacia* F406V mutant
```
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCVHEILPQPENRIVPSKTATDAIGIPRPEITY
                AIDDYVKRGAAHTREVYATAAKVLGGTDVVFNDEFAPNNHITGSTIMG
                ADARDSVVDKDCRTFDHPNLFISSSATMPTVGTVNVTLTIAALALRMSD
                TLKKEV
```

SEQ ID NO: 61 Protein sequence ORF2 (FADα) - *B. cepacia* F406I mutant
```
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCIHEILPQPENRIVPSKTATDAIGIPRPEITYA
                IDDYVKRGAAHTREVYATAAKVLGGTDVVFNDEFAPNNHITGSTIMGA
                DARDSVVDKDCRTFDHPNLFISSSATMPTVGTVNVTLTIAALALRMSDT
                LKKEV
```

SEQ ID NO: 62 Protein sequence ORF2 (FADα) - *B. cepacia* F406W mutant
```
                MADTDTQKADVVVVGSGVAGAIVAHQLAMAGKAVILLEAGPRMPRW
                EIVERFRNQPDKMDFMAPYPSSPWAPHPEYGPPNDYLILKGEHKFNSQY
                IRAVGGTTWHWAASAWRFIPNDFKMKSVYGVGRDWPIQYDDLEPYYQ
                RAEEELGVWGPGPEEDLYSPRKQPYPMPPLPLSFNEQTIKTALNNYDPK
                FHVVTEPVARNSRPYDGRPTCCGNNNCMPICPIGAMYNGIVHVEKAER
                AGAKLIENAVVYKLETGPDKRIVAALYKDKTGAEHRVEGKYFVLAANG
                IETPKILLMSANRDFPNGVANSSDMVGRNLMDHPGTGVSFYASEKLWP
                GRGPQEMTSLIGFRDGPFRATEAAKKIHLSNLSRIDQETQKIFKAGKLMK
                PDELDAQIRDRSARYVQFDCWHEILPQPENRIVPSKTATDAIGIPRPEITY
                AIDDYVKRGAAHTREVYATAAKVLGGTDVVFNDEFAPNNHITGSTIMG
```

TABLE 3-continued

Protein sequences of FAD-GDHya from *B. cepacia* (SEQ ID NO: 38, SEQ ID NOs: 40-66) and *B. lata* (SEQ ID NO: 39).

ADARDSVVDKDCRTFDHPNLFISSSATMPTVGTVNVTLTIAALALRMSD
TLKKEV

SEQ ID NO: 63 Protein sequence ORF2 (FADα) - *B. cepacia* N474H mutant
MADTDTQKADVVVVGSGVAGAIVAHQLAMAGKAVILLEAGPRMPRW
EIVERFRNQPDKMDFMAPYPSSPWAPHPEYGPPNDYLILKGEHKFNSQY
IRAVGGTTWHWAASAWRFIPNDFKMKSVYGVGRDWPIQYDDLEPYYQ
RAEEELGVWGPGPEEDLYSPRKQPYPMPPLPLSFNEQTIKTALNNYDPK
FHVVTEPVARNSRPYDGRPTCCGNNNCMPICPIGAMYNGIVHVEKAER
AGAKLIENAVVYKLETGPDKRIVAALYKDKTGAEHRVEGKYFVLAANG
IETPKILLMSANRDFPNGVANSSDMVGRNLMDHPGTGVSFYASEKLWP
GRGPQEMTSLIGFRDGPFRATEAAKKIHLSNLSRIDQETQKIFKAGKLMK
PDELDAQIRDRSARYVQFDCFHEILPQPENRIVPSKTATDAIGIPRPEITYA
IDDYVKRGAAHTREVYATAAKVLGGTDVVFNDEFAPHNHITGSTIMGA
DARDSVVDKDCRTFDHPNLFISSSATMPTVGTVNVTLTIAALALRMSDT
LKKEV SEQ ID NO: 64 Protein sequence ORF2 (FADα) - *B. cepacia* N474L mutant
MADTDTQKADVVVVGSGVAGAIVAHQLAMAGKAVILLEAGPRMPRW
EIVERFRNQPDKMDFMAPYPSSPWAPHPEYGPPNDYLILKGEHKFNSQY
IRAVGGTTWHWAASAWRFIPNDFKMKSVYGVGRDWPIQYDDLEPYYQ
RAEEELGVWGPGPEEDLYSPRKQPYPMPPLPLSFNEQTIKTALNNYDPK
FHVVTEPVARNSRPYDGRPTCCGNNNCMPICPIGAMYNGIVHVEKAER
AGAKLIENAVVYKLETGPDKRIVAALYKDKTGAEHRVEGKYFVLAANG
IETPKILLMSANRDFPNGVANSSDMVGRNLMDHPGTGVSFYASEKLWP
GRGPQEMTSLIGFRDGPFRATEAAKKIHLSNLSRIDQETQKIFKAGKLMK
PDELDAQIRDRSARYVQFDCFHEILPQPENRIVPSKTATDAIGIPRPEITYA
IDDYVKRGAAHTREVYATAAKVLGGTDVVFNDEFAPLNHITGSTIMGA
DARDSVVDKDCRTFDHPNLFISSSATMPTVGTVNVTLTIAALALRMSDT
LKKEV SEQ ID NO: 65 Protein sequence ORF2 (FADα) - *B. cepacia* N474S mutant
MADTDTQKADVVVVGSGVAGAIVAHQLAMAGKAVILLEAGPRMPRW
EIVERFRNQPDKMDFMAPYPSSPWAPHPEYGPPNDYLILKGEHKFNSQY
IRAVGGTTWHWAASAWRFIPNDFKMKSVYGVGRDWPIQYDDLEPYYQ
RAEEELGVWGPGPEEDLYSPRKQPYPMPPLPLSFNEQTIKTALNNYDPK
FHVVTEPVARNSRPYDGRPTCCGNNNCMPICPIGAMYNGIVHVEKAER
AGAKLIENAVVYKLETGPDKRIVAALYKDKTGAEHRVEGKYFVLAANG
IETPKILLMSANRDFPNGVANSSDMVGRNLMDHPGTGVSFYASEKLWP
GRGPQEMTSLIGFRDGPFRATEAAKKIHLSNLSRIDQETQKIFKAGKLMK
PDELDAQIRDRSARYVQFDCFHEILPQPENRIVPSKTATDAIGIPRPEITYA
IDDYVKRGAAHTREVYATAAKVLGGTDVVFNDEFAPSNHITGSTIMGA
DARDSVVDKDCRTFDHPNLFISSSATMPTVGTVNVTLTIAALALRMSDT
LKKEV SEQ ID NO: 66 Protein sequence ORF2 (FADα) - *B. cepacia* N474V mutant
MADTDTQKADVVVVGSGVAGAIVAHQLAMAGKAVILLEAGPRMPRW
EIVERFRNQPDKMDFMAPYPSSPWAPHPEYGPPNDYLILKGEHKFNSQY
IRAVGGTTWHWAASAWRFIPNDFKMKSVYGVGRDWPIQYDDLEPYYQ
RAEEELGVWGPGPEEDLYSPRKQPYPMPPLPLSFNEQTIKTALNNYDPK
FHVVTEPVARNSRPYDGRPTCCGNNNCMPICPIGAMYNGIVHVEKAER
AGAKLIENAVVYKLETGPDKRIVAALYKDKTGAEHRVEGKYFVLAANG
IETPKILLMSANRDFPNGVANSSDMVGRNLMDHPGTGVSFYASEKLWP
GRGPQEMTSLIGFRDGPFRATEAAKKIHLSNLSRIDQETQKIFKAGKLMK
PDELDAQIRDRSARYVQFDCFHEILPQPENRIVPSKTATDAIGIPRPEITYA
IDDYVKRGAAHTREVYATAAKVLGGTDVVFNDEFAPVNHITGSTIMGA
DARDSVVDKDCRTFDHPNLFISSSATMPTVGTVNVTLTIAALALRMSDT
LKKEV

TABLE 4

Protein sequences of FAD-GDHya for *B. lata* mutants with removable 6x-His tag.

| SEQ ID | Sequence |
|---|---|
| SEQ ID NO: 67 | Protein sequence ORF2 (FADα) - *B. lata* F406A mutant
MADTDTQKADVVVVGSGVAGAIVAHQLAMAGKSVILLEAGPRMPRWE
IVERFRNQVDKTDFMAPYPSSAWAPHPEYGPPNDYLILKGEHKFNSQYI
RAVGGTTWHWAASAWRFIPNDFKMKTVYGVGRDWPIQYDDIEHYYQR
AEEELGVWGPGPEEDLYSPRKEPYPMPPLPLSFNEQTIKSALNGYDPKFH
VVTEPVARNSRPYDGRPTCCGNNNCMPICPIGAMYNGIVHVEKAEQAG
AKLIDSAVVYKLETGPDKRITAAVYKDKTGADHRVEGKYFVIAANGIET
PKILLMSANRDFPNGVANSSDMVGRNLMDHPGTGVSFYANEKLWPGR |

TABLE 4-continued

Protein sequences of FAD-GDHya for *B. lata* mutants with removable 6x-His tag.

| SEQ ID | Sequence |
| --- | --- |
| | GPQEMTSLIGFRDGPFRANEAAKKIHLSNMSRINQETQKIFKGGKLMKP<br>EELDAQIRDRSARFVQFDCAHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH |
| SEQ ID NO: 68 | Protein sequence ORF2 (FADα) - *B. lata* F406C mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCCHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH* |
| SEQ ID NO: 69 | Protein sequence ORF2 (FADα) - *B. lata* F406D mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCDHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH* |
| SEQ ID NO: 70 | Protein sequence ORF2 (FADα) - *B. lata* F406E mutant<br>MADTDTQKADVVVVGSGVA TABLE 4-continued Protein sequences of FAD-GDHya for *B. lata* mutants with removable 6x-His tag.

| SEQ ID | Sequence |
| --- | --- |

SEQ ID NO: 73 Protein sequence ORF2 (FADα) - *B. lata* F406I mutant
MADTDTQKADVVVVGSGVAGAIVAHQLAMAGKSVILLEAGPRMPRWE
IVERFRNQVDKTDFMAPYPSSAWAPHPEYGPPNDYLILKGEHKFNSQYI
RAVGGTTWHWAASAWRFIPNDFKMKTVYGVGRDWPIQYDDIEHYYQR
AEEELGVWGPGPEEDLYSPRKEPYPMPPLPLSFNEQTIKSALNGYDPKFH
VVTEPVARNSRPYDGRPTCCGNNNCMPICPIGAMYNGIVHVEKAEQAG
AKLIDSAVVYKLETGPDKRITAAVYKDTGADHRVEGKYFVIAANGIET
PKILLMSANRDFPNGVANSSDMVGRNLMDHPGTGVSFYANEKLWPGR
GPQEMTSLIGFRDGPFRANEAAKKIHLSNMSRINQETQKIFKGGKLMKP
EELDAQIRDRSARFVQFDCIHEILPQPENRIVPSKTATDAVGIPRPEITYAI
DDYVKRGAVHTREVYATAAKVLGGTEVVFNDEFAPNNHITGATIMGA
DARDSVVDKDCRAFDHPNLFISSSSTMPTVGTVNVTLTIAALALRMSDT
LKKEVGSGSGHHHHHH*

SEQ ID NO: 74 Protein sequence ORF2 (FADα) - *B. lata* F406K mutant
MADTDTQKADVVVVGSGVAGAIVAHQLAMAGKSVILLEAGPRMPRWE
IVERFRNQVDKTDFMAPYPSSAWAPHPEYGPPNDYLILKGEHKFNSQYI
RAVGGTTWHWAASAWRFIPNDFKMKTVYGVGRDWPIQYDDIEHYYQR
AEEELGVWGPGPEEDLYSPRKEPYPMPPLPLSFNEQTIKSALNGYDPKFH
VVTEPVARNSRPYDGRPTCCGNNNCMPICPIGAMYNGIVHVEKAEQAG
AKLIDSAVVYKLETGPDKRITAAVYKDTGADHRVEGKYFVIAANGIET
PKILLMSANRDFPNGVANSSDMVGRNLMDHPGTGVSFYANEKLWPGR
GPQEMTSLIGFRDGPFRANEAAKKIHLSNMSRINQETQKIFKGGKLMKP
EELDAQIRDRSARFVQFDCKHEILPQPENRIVPSKTATDAVGIPRPEITYAI
DDYVKRGAVHTREVYATAAKVLGGTEVVFNDEFAPNNHITGATIMGA
DARDSVVDKDCRAFDHPNLFISSSSTMPTVGTVNVTLTIAALALRMSDT
LKKEVGSGSGHHHHHH*

SEQ ID NO: 75 Protein sequence ORF2 (FADα) - *B. lata* F406L mutant
MADTDTQKADVVVVGSGVAGAIVAHQLAMAGKSVILLEAGPRMPRWE
IVERFRNQVDKTDFMAPYPSSAWAPHPEYGPPNDYLILKGEHKFNSQYI
RAVGGTTWHWAASAWRFIPNDFKMKTVYGVGRDWPIQYDDIEHYYQR
AEEELGVWGPGPEEDLYSPRKEPYPMPPLPLSFNEQTIKSALNGYDPKFH
VVTEPVARNSRPYDGRPTCCGNNNCMPICPIGAMYNGIVHVEKAEQAG
AKLIDSAVVYKLETGPDKRITAAVYKDTGADHRVEGKYFVIAANGIET
PKILLMSANRDFPNGVANSSDMVGRNLMDHPGTGVSFYANEKLWPGR
GPQEMTSLIGFRDGPFRANEAAKKIHLSNMSRINQETQKIFKGGKLMKP
EELDAQIRDRSARFVQFDCLHEILPQPENRIVPSKTATDAVGIPRPEITYAI
DDYVKRGAVHTREVYATAAKVLGGTEVVFNDEFAPNNHITGATIMGA
DARDSVVDKDCRAFDHPNLFISSSSTMPTVGTVNVTLTIAALALRMSDT
LKKEVGSGSGHHHHHH*

SEQ ID NO: 76 Protein sequence ORF2 (FADα) - *B. lata* F406M mutant
MADTDTQKADVVVVGSGVAGAIVAHQLAMAGKSVILLEAGPRMPRWE
IVERFRNQVDKTDFMAPYPSSAWAPHPEYGPPNDYLILKGEHKFNSQYI
RAVGGTTWHWAASAWRFIPNDFKMKTVYGVGRDWPIQYDDIEHYYQR
AEEELGVWGPGPEEDLYSPRKEPYPMPPLPLSFNEQTIKSALNGYDPKFH
VVTEPVARNSRPYDGRPTCCGNNNCMPICPIGAMYNGIVHVEKAEQAG
AKLIDSAVVYKLETGPDKRITAAVYKDTGADHRVEGKYFVIAANGIET
PKILLMSANRDFPNGVANSSDMVGRNLMDHPGTGVSFYANEKLWPGR
GPQEMTSLIGFRDGPFRANEAAKKIHLSNMSRINQETQKIFKGGKLMKP
EELDAQIRDRSARFVQFDCMHEILPQPENRIVPSKTATDAVGIPRPEITYA
IDDYVKRGAVHTREVYATAAKVLGGTEVVFNDEFAPNNHITGATIMGA
DARDSVVDKDCRAFDHPNLFISSSSTMPTVGTVNVTLTIAALALRMSDT
LKKEVGSGSGHHHHHH*

SEQ ID NO: 77 Protein sequence ORF2 (FADα) - *B. lata* F406N mutant
MADTDTQKADVVVVGSGVAGAIVAHQLAMAGKSVILLEAGPRMPRWE
IVERFRNQVDKTDFMAPYPSSAWAPHPEYGPPNDYLILKGEHKFNSQYI
RAVGGTTWHWAASAWRFIPNDFKMKTVYGVGRDWPIQYDDIEHYYQR
AEEELGVWGPGPEEDLYSPRKEPYPMPPLPLSFNEQTIKSALNGYDPKFH
VVTEPVARNSRPYDGRPTCCGNNNCMPICPIGAMYNGIVHVEKAEQAG
AKLIDSAVVYKLETGPDKRITAAVYKDTGADHRVEGKYFVIAANGIET
PKILLMSANRDFPNGVANSSDMVGRNLMDHPGTGVSFYANEKLWPGR
GPQEMTSLIGFRDGPFRANEAAKKIHLSNMSRINQETQKIFKGGKLMKP
EELDAQIRDRSARFVQFDCNHEILPQPENRIVPSKTATDAVGIPRPEITYAI
DDYVKRGAVHTREVYATAAKVLGGTEVVFNDEFAPNNHITGATIMGA
DARDSVVDKDCRAFDHPNLFISSSSTMPTVGTVNVTLTIAALALRMSDT
LKKEVGSGSGHHHHHH*

SEQ ID NO: 78 Protein sequence ORF2 (FADα) - *B. lata* F406Q mutant
MADTDTQKADVVVVGSGVAGAIVAHQLAMAGKSVILLEAGPRMPRWE
IVERFRNQVDKTDFMAPYPSSAWAPHPEYGPPNDYLILKGEHKFNSQYI
RAVGGTTWHWAASAWRFIPNDFKMKTVYGVGRDWPIQYDDIEHYYQR

TABLE 4-continued

Protein sequences of FAD-GDHya for *B. lata* mutants with removable 6x-His tag.

| SEQ ID | Sequence |
| --- | --- |
|  | AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCQHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH* |
| SEQ ID NO: 79 | Protein sequence ORF2 (FADα) - *B. lata* F406S mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCSHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH* |
| SEQ ID NO: 80 | Protein sequence ORF2 (FADα) - *B. lata* F406P mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCPHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH* |
| SEQ ID NO: 81 | Protein sequence ORF2 (FADα) - *B. lata* F406V mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCVHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH* |
| SEQ ID NO: 82 | Protein sequence ORF2 (FADα) - *B. lata* F406R mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCRHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH* |
| SEQ ID NO: 83 | Protein sequence ORF2 (FADα) - *B. lata* F406T mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSAL TABLE 4-continued Protein sequences of FAD-GDHya for *B. lata* mutants with removable 6x-His tag.

| SEQ ID | Sequence |
|---|---|
| | EELDAQIRDRSARFVQFDCTHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH* |
| SEQ ID NO: 84 | Protein sequence ORF2 (FADα) - *B. lata* F406W mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCWHEILPQPENRIVPSKTATDAVGIPRPEITYA<br>IDDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH* |
| SEQ ID NO: 85 | Protein sequence ORF2 (FADα) - *B. lata* F406Y mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCYHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH* |

TABLE 5

Protein sequences of FAD-GDHya for *B. lata* mutants.

| SEQ ID | Sequence |
|---|---|
| SEQ ID NO: 86 | Protein sequence ORF2 (FADα) - *B. lata* F406A mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCAHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 87 | Protein sequence ORF2 (FADα) - *B. lata* F406C mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCCHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 88 | Protein sequence ORF2 (FADα) - *B. lata* F406D mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH |

TABLE 5-continued

Protein sequences of FAD-GDHya for *B. lata* mutants.

| SEQ ID | Sequence |
|---|---|
| | VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCDHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 89 | Protein sequence ORF2 (FADα) - *B. lata* F406E mutant<br>MADTDTQKADVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCEHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 90 | Protein sequence ORF2 (FADα) - *B. lata* F406G mutant<br>MADTDTQKADVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCGHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 91 | Protein sequence ORF2 (FADα) - *B. lata* F406H mutant<br>MADTDTQKADVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCHHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 92 | Protein sequence ORF2 (FADα) - *B. lata* F406I mutant<br>MADTDTQKADVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCIHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 93 | Protein sequence ORF2 (FADα) - *B. lata* F406K mutant<br>MADTDTQKADVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCKHEILPQPENRIVPSKTATDAVGIPRPEITYAI<br>DDYVKRGAVHTREVYATAAKVLGGTEVVFNDEFAPNNHITGATIMGA |

TABLE 5-continued

Protein sequences of FAD-GDHya for B. lata mutants.

| SEQ ID | Sequence |
|---|---|
| | DARDSVVDKDCRAFDHPNLFISSSSTMPTVGTVNVTLTIAALALRMSDT<br>LKKEV |
| SEQ ID NO: 94 | Protein sequence ORF2 (FADα) - B. lata F406L mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCLHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 95 | Protein sequence ORF2 (FADα) - B. lata F406M mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCMHEILPQPENRIVPSKTATDAVGIPRPEITYA<br>IDDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 96 | Protein sequence ORF2 (FADα) - B. lata F406N mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCNHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 97 | Protein sequence ORF2 (FADα) - B. lata F406Q mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCQHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 98 | Protein sequence ORF2 (FADα) - B. lata F406S mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCSHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 99 | Protein sequence ORF2 (FADα) - B. lata F406P mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI |

TABLE 5-continued

Protein sequences of FAD-GDHya for B. lata mutants.

| SEQ ID | Sequence |
|---|---|
| | RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCPHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEV |
| SEQ ID NO: 100 | Protein sequence ORF2 (FADα) - B. lata F406V mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCVHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSG |
| SEQ ID NO: 101 | Protein sequence ORF2 (FADα) - B. lata F406R mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCRHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSG |
| SEQ ID NO: 102 | Protein sequence ORF2 (FADα) - B. lata F406T mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCTHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSG |
| SEQ ID NO: 103 | Protein sequence ORF2 (FADα) - B. lata F406W mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCWHEILPQPENRIVPSKTATDAVGIPRPEITYA<br>IDDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSG |
| SEQ ID NO: 104 | Protein sequence ORF2 (FADα) - B. lata F406Y mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP |

TABLE 5-continued

Protein sequences of FAD-GDHya for *B. lata* mutants.

| SEQ ID | Sequence |
|---|---|
| | EELDAQIRDRSARFVQFDCYHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSG |

TABLE 6

Protein sequences according to some embodiments of the present invention.

| SEQ ID | Sequence |
|---|---|
| SEQ ID NO: 105 | Protein sequence ORF2 (FADα) - N215D<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGDNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCFHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 106 | Protein sequence ORF2 (FADα) - N215G<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGGNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCFHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 107 | Protein sequence ORF2 (FADα) - N215H<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGHNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLWP<br>GRGPQEMTSLIGFRDGPFRATEAAKKIHLSNLSRIDQETQKIFKAGKLMK<br>PDELDAQIRDRSARYVQFDCFHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 108 | Protein sequence ORF2 (FADα) - N215T<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGTNNCMPICPIGAMYNGIVHVEKAERA<br>GAKLIENAVVYKLETGPDKRIVAALYKDKTGAEHRVEGKYFVLAANGI<br>ETPKILLMSANRDFPNGVANSSDMVGRNLMDHPGTGVSFYASEKLWPG<br>RGPQEMTSLIGFRDGPFRATEAAKKIHLSNLSRIDQETQKIFKAGKLMKP<br>DELDAQIRDRSARYVQFDCFHEILPQPENRIVPSKTATDAIGIPRPEITYAI<br>DDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO. 109 | Protein sequence ORF2 (FADα) - N215Y<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK |

TABLE 6-continued

Protein sequences according to some embodiments of the present invention.

| SEQ ID | Sequence |
|---|---|
| | FHVVTEPVARNSRPYDGRPTCCGYNNCMPICPIGAMYNGIVHVEKAER
AGAKLIENAVVYKLETGPDKRIVAALYKDKTGAEHRVEGKYFVLAANG
IETPKILLMSANRDFPNGVANSSDMVGRNLMDHPGTGVSFYASEKLWP
GRGPQEMTSLIGFRDGPFRATEAAKKIHLSNLSRIDQETQKIFKAGKLMK
PDELDAQIRDRSARYVQFDCFHEILPQPENRIVPSKTATDAIGIPRPEITYA
IDDYVKRGAAHTREVYATAAKVLGGTDVVFNDEFAPNNHITGSTIMGA
DARDSVVDKDCRTFDHPNLFISSSATMPTVGTVNVTLTIAALALRMSDT
LKKEVGSGSGHHHHHH |
| SEQ ID NO: 110 | Protein sequence ORF2 (FADα) - B. cepacia
N177S, N215S, F353L, F406L mutant
MADTDTQKADVVVVGSGVAGAIVAHQLAMAGKAVILLEAGPRTPRWE
IVERFRNQPDKMDFMAPYPSSWAPHPEYGPPNDYLILKGEHKFNSQYIR
AVGGTTWHWAASAWRFIPNDFKMKSVYGVGRDWPIQYDDLEPYYQR
AEEELGVWGPGPEEDLYSPRKQPYPMPPLPLSFSEQTIKTALNNYDPKFH
VVTEPVARNSRPYDGRPTCCGSNNCMPICPIGAMYNGIVHVEKAERAG
AKLIENAVVYKLETGPDKRIVAALYKDKTGAEHRVEGKYFVLAANGIE
TPRILLMSANRDFPNGVANSSDMVGRNLMDHPGTGVSFYASEKLWPGR
GPQEMTSLVGFRDGPLRATEAAKKIHLSNLSRIDQETQKIFKAGKLMKP
DELDAQIRDRSARYVQFDCLHEILPQPENRIVPSKTATDAIGIPRPEITYAI
DDYVKRGAAHTREVYATAAKVLGGTDVVFNDEFAPNDHITGSTIMGA
DARDSVVDKDCRTFDHPNLFISSSATMPTVGTVNVTLTIAALALRMSDT
LKKEVGSGSGHHHHHH |
| SEQ ID NO: 111 | Protein sequence ORF2 (FADα) - B. lata
N177S, N215S, F353L, F406L mutant
MADTDTQKADVVVVGSGVAGAIVAHQLAMAGKSVILLEAGPRMPRWE
IVERFRNQVDKTDFMAPYPSSAWAPHPEYGPPNDYLILKGEHKFNSQYI
RAVGGTTWHWAASAWRFIPNDFKMKTVYGVGRDWPIQYDDIEHYYQR
AEEELGVWGPGPEEDLYSPRKEPYPMPPLPLSFSEQTIKSALNGYDPKFH
VVTEPVARNSRPYDGRPTCCGSNNCMPICPIGAMYNGIVHVEKAEQAG
AKLIDSAVVYKLETGPDKRITAAVYKDKTGADHRVEGKYFVIAANGIET
PKILLMSANRDFPNGVANSSDMVGRNLMDHPGTGVSFYANEKLWPGR
GPQEMTSLIGFRDGPLRANEAAKKIHLSNMSRINQETQKIFKGGKLMKP
EELDAQIRDRSARFVQFDCLHEILPQPENRIVPSKTATDAVGIPRPEITYAI
DDYVKRGAVHTREVYATAAKVLGGTEVVFNDEFAPNNHITGATIMGA
DARDSVVDKDCRAFDHPNLFISSSSTMPTVGTVNVTLTIAALALRMSDT
LKKEVGSGSGHHHHHH |
| SEQ ID NO: 112 | Protein sequence ORF2 (FADα) - B. lata N215S mutant
MADTDTQKADVVVVGSGVAGAIVAHQLAMAGKSVILLEAGPRMPRWE
IVERFRNQVDKTDFMAPYPSSAWAPHPEYGPPNDYLILKGEHKFNSQYI
RAVGGTTWHWAASAWRFIPNDFKMKTVYGVGRDWPIQYDDIEHYYQR
AEEELGVWGPGPEEDLYSPRKEPYPMPPLPLSFNEQTIKSALNGYDPKFH
VVTEPVARNSRPYDGRPTCCGSNNCMPICPIGAMYNGIVHVEKAEQAG
AKLIDSAVVYKLETGPDKRITAAVYKDKTGADHRVEGKYFVIAANGIET
PKILLMSANRDFPNGVANSSDMVGRNLMDHPGTGVSFYANEKLWPGR
GPQEMTSLIGFRDGPFRANEAAKKIHLSNMSRINQETQKIFKGGKLMKP
EELDAQIRDRSARFVQFDCFHEILPQPENRIVPSKTATDAVGIPRPEITYAI
DDYVKRGAVHTREVYATAAKVLGGTEVVFNDEFAPNNHITGATIMGA
DARDSVVDKDCRAFDHPNLFISSSSTMPTVGTVNVTLTIAALALRMSDT
LKKEVGSGSGHHHHHH |
| SEQ ID NO: 113 | Protein sequence ORF2 (FADα) - B. lata N215T mutant
MADTDTQKADVVVVGSGVAGAIVAHQLAMAGKSVILLEAGPRMPRWE
IVERFRNQVDKTDFMAPYPSSAWAPHPEYGPPNDYLILKGEHKFNSQYI
RAVGGTTWHWAASAWRFIPNDFKMKTVYGVGRDWPIQYDDIEHYYQR
AEEELGVWGPGPEEDLYSPRKEPYPMPPLPLSFNEQTIKSALNGYDPKFH
VVTEPVARNSRPYDGRPTCCGTNNCMPICPIGAMYNGIVHVEKAEQAG
AKLIDSAVVYKLETGPDKRITAAVYKDKTGADHRVEGKYFVIAANGIET
PKILLMSANRDFPNGVANSSDMVGRNLMDHPGTGVSFYANEKLWPGR
GPQEMTSLIGFRDGPFRANEAAKKIHLSNMSRINQETQKIFKGGKLMKP
EELDAQIRDRSARFVQFDCFHEILPQPENRIVPSKTATDAVGIPRPEITYAI
DDYVKRGAVHTREVYATAAKVLGGTEVVFNDEFAPNNHITGATIMGA
DARDSVVDKDCRAFDHPNLFISSSSTMPTVGTVNVTLTIAALALRMSDT
LKKEVGSGSGHHHHHH |
| SEQ ID NO: 114 | Protein sequence ORF2 (FADα) - B. cepacia N177S mutant
MADTDTQKADVVVVGSGVAGAIVAHQLAMAGKAVILLEAGPRMPRW
EIVERFRNQPDKMDFMAPYPSSPWAPHPEYGPPNDYLILKGEHKFNSQY
IRAVGGTTWHWAASAWRFIPNDFKMKSVYGVGRDWPIQYDDLEPYYQ
RAEEELGVWGPGPEEDLYSPRKQPYPMPPLPLSFSEQTIKTALNNYDPKF
HVVTEPVARNSRPYDGRPTCCGNNNCMPICPIGAMYNGIVHVEKAERA
GAKLIENAVVYKLETGPDKRIVAALYKDKTGAEHRVEGKYFVLAANGI
ETPKILLMSANRDFPNGVANSSDMVGRNLMDHPGTGVSFYASEKLWPG |

TABLE 6-continued

Protein sequences according to some embodiments of the present invention.

| SEQ ID | Sequence |
| --- | --- |
| | RGPQEMTSLIGFRDGPFRATEAAKKIHLSNLSRIDQETQKIFKAGKLMKP<br>DELDAQIRDRSARYVQFDCFHEILPQPENRIVPSKTATDAIGIPRPEITYAI<br>DDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 115 | Protein sequence ORF2 (FADα) - B. lata N177S mutant<br>MADTDTQKADVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFSEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCFHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH |
| SEQ ID NO: 116 | Protein sequence ORF2 (FADα) - B. cepacia F353L mutant<br>MADTDTQKADVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGNNNCMPICPIGAMYNGIVHVEKAER<br>AGAKLIENAVVYKLETGPDKRIVAALYKDKTGAEHRVEGKYFVLAANG<br>IETPKILLMSANRDFPNGVANSSDMVGRNLMDHPGTGVSFYASEKLLWP<br>GRGPQEMTSLIGFRDGPLRATEAAKKIHLSNLSRIDQETQKIFKAGKLMK<br>PDELDAQIRDRSARYVQFDCFHEILPQPENRIVPSKTATDAIGIPRPEITYA<br>IDDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 117 | Protein sequence ORF2 (FADα) - B. lata F353L mutant<br>MADTDTQKADVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPLRANEAAKKIHLSNMSRINQETQKIFKGGKLMKP<br>EELDAQIRDRSARFVQFDCFHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH |
| SEQ ID NO: 118 | Protein sequence ORF2 (FADα) - B. cepacia N177S, F406L mutant<br>MADTDTQKADVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSSEQTIKTALNNYDPKF<br>HVVTEPVARNSRPYDGRPTCCGNNNCMPICPIGAMYNGIVHVEKAERA<br>GAKLIENAVVYKLETGPDKRIVAALYKDKTGAEHRVEGKYFVLAANGI<br>ETPKILLMSANRDFPNGVANSSDMVGRNLMDHPGTGVSFYASEKLWPG<br>RGPQEMTSLIGFRDGPFRATEAAKKIHLSNLSRIDQETQKIFKAGKLMKP<br>DELDAQIRDRSARYVQFDCLHEILPQPENRIVPSKTATDAIGIPRPEITYAI<br>DDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 119 | Protein sequence ORF2 (FADα) - B. lata N177S, F406L mutant<br>MADTDTQKADVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFSEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCLHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH |

TABLE 6-continued

Protein sequences according to some embodiments of the present invention.

| SEQ ID | Sequence |
|---|---|

SEQ ID NO: 120 Protein sequence ORF2 (FADα) - B. cepacia F353L, F406L mutant
MADTDTQKADVVVVGSGVAGAIV TABLE 6-continued Protein sequences according to some embodiments of the present invention.

| SEQ ID | Sequence |
| --- | --- |
| | RAVGGTTWHWAASAWRFIPNDFKMKTVYGVGRDWPIQYDDIEHYYQR<br>AEEELGVWGPGPEEDLYSPRKEPYPMPPLPLSFSEQTIKSALNGYDPKFH<br>VVTEPVARNSRPYDGRPTCCGNNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPLRANEAAKKIHLSNMSRINQETQKIFKGGKLMKP<br>EELDAQIRDRSARFVQFDCLHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH |
| SEQ ID NO: 126 | Protein sequence ORF2 (FADα) - B. cepacia N177S, N215S, F406L mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFSEQTIKTALNNYDPKF<br>HVVTEPVARNSRPYDGRPTCCGSNNCMPICPIGAMYNGIVHVEKAERA<br>GAKLIENAVVYKLETGPDKRIVAALYKDKTGAEHRVEGKYFVLAANGI<br>ETPKILLMSANRDFPNGVANSSDMVGRNLMDHPGTGVSFYASEKLWPG<br>RGPQEMTSLIGFRDGPFRATEAAKKIHLSNLSRIDQETQKIFKAGKLMKP<br>DELDAQIRDRSARYVQFDCLHEILPQPENRIVPSKTATDAIGIPRPEITYAI<br>DDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 127 | Protein sequence ORF2 (FADα) - *B. lata* N177S, N215S, F406L mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFSEQTIKSALNGYDPKFH<br>VVTEPVARNSRPYDGRPTCCGSNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPFRANEAAKKIHLSNMSRINQETQKIFKGGKLMKP<br>EELDAQIRDRSARFVQFDCLHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH |
| SEQ ID NO: 128 | Protein sequence ORF2 (FADα) - *B. cepacia* N215S, F353L, F406L mutant<br>MADTDTQKADVVVVGSGVAGAIVAHQLAMAGKAVILLEAGPRMPRW<br>EIVERFRNQPDKMDFMAPYPSSPWAPHPEYGPPNDYLILKGEHKFNSQY<br>IRAVGGTTWHWAASAWRFIPNDFKMKSVYGVGRDWPIQYDDLEPYYQ<br>RAEEELGVWGPGPEEDLYSPRKQPYPMPPLPLSFNEQTIKTALNNYDPK<br>FHVVTEPVARNSRPYDGRPTCCGSNNCMPICPIGAMYNGIVHVEKAERA<br>GAKLIENAVVYKLETGPDKRIVAALYKDKTGAEHRVEGKYFVLAANGI<br>ETPKILLMSANRDFPNGVANSSDMVGRNLMDHPGTGVSFYASEKLWPG<br>RGPQEMTSLIGFRDGPLRATEAAKKIHLSNLSRIDQETQKIFKAGKLMKP<br>DELDAQIRDRSARYVQFDCLHEILPQPENRIVPSKTATDAIGIPRPEITYAI<br>DDYVKRGAAHTREVYATAAKVLGGTDVVFNDEFAPNNHITGSTIMGA<br>DARDSVVDKDCRTFDHPNLFISSSATMPTVGTVNVTLTIAALALRMSDT<br>LKKEVGSGSGHHHHHH |
| SEQ ID NO: 129 | Protein sequence ORF2 (FADα) - *B. lata* N215S, F353L, F406L mutant<br>MADTDTQKADVVVVGSGVAGAIVAHQLAMAGKSVILLEAGPRMPRWE<br>IVERFRNQVDKTDFMAPYPSSAWAPHPEYGPPNDYLILKGEHKFNSQYI<br>RAVGGTTWHWAASAWRFIPNDFKMKTVYGVGRDWPIQYDDIEHYYQR<br>AEEELGVWGPGPEEDLYSPRKEPYPMPPLPLSFNEQTIKSALNGYDPKFH<br>VVTEPVARNSRPYDGRPTCCGSNNCMPICPIGAMYNGIVHVEKAEQAG<br>AKLIDSAVVYKLETGPDKRITAAVYKDKTGADHRVEGKYFVIAANGIET<br>PKILLMSANRDFPNGVANSSDMVGRNLMDHPGTGVSFYANEKLWPGR<br>GPQEMTSLIGFRDGPLRANEAAKKIHLSNMSRINQETQKIFKGGKLMKP<br>EELDAQIRDRSARFVQFDCLHEILPQPENRIVPSKTATDAVGIPRPEITYAI<br>DDYVKRGAVHTREVYATAAKVLGGTEVVFNDEFAPNNHITGATIMGA<br>DARDSVVDKDCRAFDHPNLFISSSSTMPTVGTVNVTLTIAALALRMSDT<br>LKKEVGSGSGHHHHHH |

FIGS. 19A-B show some aspects of some embodiments of the present invention. FIG. 19A shows electrochemical data representing the current response of the biosensor comprising of FAD-GDHα N215G to various glucose concentrations (shown as a square) and the linear fit across the data range is represented by the $R^2$ value. FIG. 19B shows the non-linear fit of the data shown in FIG. 19A, from which $K_m$ (k) and $V_{max}$ have been calculated.

FIGS. 20A-B show some aspects of some embodiments of the present invention. FIG. 20A shows electrochemical data representing the current response of the biosensor comprising of FAD-GDHα N215H to various glucose concentrations (shown as a square) and the linear fit across the data range is represented by the $R^2$ value. FIG. 20B shows the non-linear fit of the data shown in FIG. 20A, from which $K_m$ (k) and $V_{max}$ have been calculated.

FIGS. 21A-B show some aspects of some embodiments of the present invention. FIG. 21A shows electrochemical data representing the current response of the biosensor comprising of FAD-GDHα N215T to various glucose concentrations (shown as a square) and the linear fit across the data range is represented by the $R^2$ value. FIG. 21B shows the non-linear fit of the data shown in FIG. 21A, from which $K_m$ (k) and $V_{max}$ have been calculated.

FIGS. 22A-B show some aspects of some embodiments of the present invention. FIG. 22A shows electrochemical data representing the current response of the biosensor comprising of FAD-GDHα N215D to various glucose concentrations (shown as a square) and the linear fit across the data range is represented by the $R^2$ value. FIG. 22B shows the non-linear fit of the data shown in FIG. 22A, from which $K_m$ (k) and $V_{max}$ have been calculated.

FIGS. 23A-B show some aspects of some embodiments of the present invention. FIG. 23A shows electrochemical data representing the current response of the biosensor comprising of FAD-GDHα N215Y to various glucose concentrations (shown as a square) and the linear fit across the data range is represented by the $R^2$ value. FIG. 23B shows the non-linear fit of the data shown in FIG. 23A, from which $K_m$ (k) and $V_{max}$ have been calculated.

FIGS. 24A-B show some aspects of some embodiments of the present invention. FIG. 24A shows electrochemical data representing the current response of the biosensor comprising of FAD-GDHα N215S to various glucose concentrations (shown as a square) and the linear fit across the data range is represented by the $R^2$ value. FIG. 24B shows the non-linear fit of the data shown in FIG. 24A, from which $K_m$ (k) and $V_{max}$ have been calculated.

FIG. 25 shows electrochemistry data in connection with the wild type FAD-GDHα protein.

FIG. 26 shows a table of electrochemistry data of the embodiments of the composition of the present invention. Mutations in position 406 provide improved linearity over the entire range of physiological range: F406-S/C/T/V/Y/N/P/L/G/A/I/D/E.

FIG. 27 shows embodiments of the composition of the present invention. Mutations in position 406 that provide improved selectivity of glucose: F406-S/C/T/M/V/Y/N/P/L/G/Q/A/I/D/H/E. F406W provides an example of a substitution that reduces the enzyme selectivity towards glucose. Mutations in position 215 provide improved linearity over the entire range of physiological range: N215-G/H/T/D/Y/S.

Figure 25A:
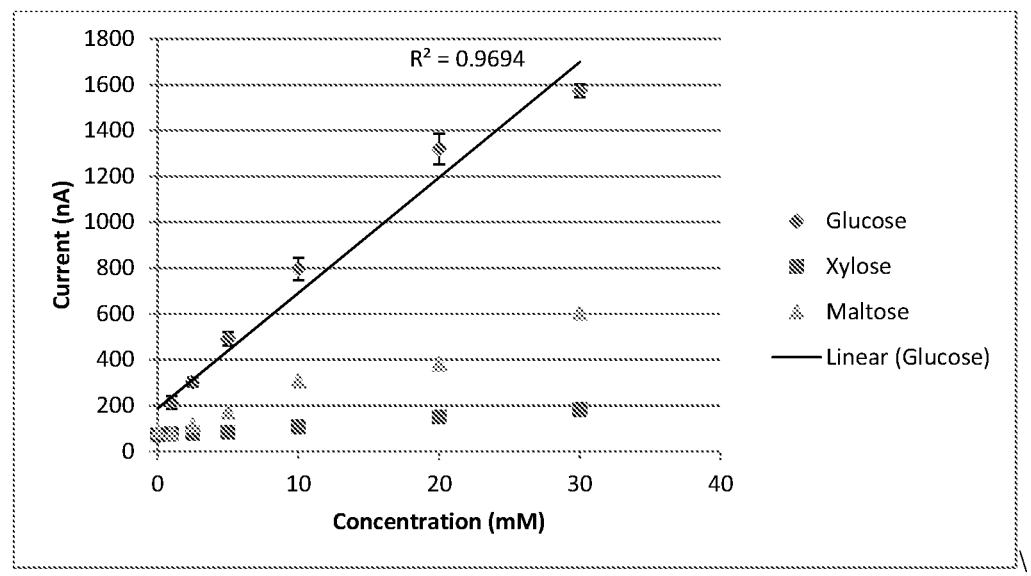
FIG. 25A shows electrochemical data representing the current response of the biosensor to various glucose concentrations (shown as a rhombus), maltose concentrations (shown as a triangle) and xylose (shown as a rectangle) concentrations (substrate solution were supplemented with 1 mM benzoquinone). $R^2$ represents a linear fit of the glucose data.
Figure 25B:
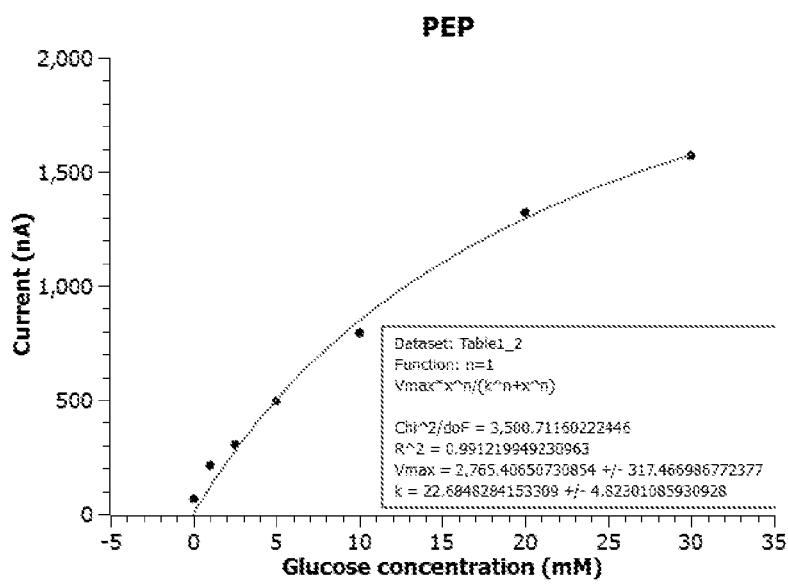
FIG. 25B shows a biosensor response to glucose and the non-linear fit through which apparent $K_m$ (k) and $I_{max}$ have been calculated based on Michaelis-Menten $$I = \frac{I\max[S]}{Km + [S]} \qquad \text{Equation 1}$$

An exemplary embodiment of the FAD-GDHα composition of the present invention is shown in FIGS. 25A and 25B, showing a graphical representation of the electrochemical response of a mutated FAD-GDHα (N177S, N215S, F353L, F406L) to various substrates. FIG. 25A shows electrochemical data representing the current response of the biosensor to various glucose concentrations (shown as a rhombus), maltose concentrations (shown as a triangle) and xylose (shown as a rectangle) concentrations (substrate solution were supplemented with 1 mM benzoquinone). $R^2$ represents a linear fit of the glucose data. FIG. 25B shows a biosensor response to glucose and the non-linear fit through which apparent Km (k) and Imax have been calculated based on Michaelis-Menten equation:

$$I = \frac{I\max[S]}{Km + [S]} \qquad \text{Equation 1}$$

Whereas "I" is the current, S is the substrate concentration, Imax is the maximum current and the Km is the apparent Michaelis constant.

FIG. 26A shows an exemplary embodiment of a bioelectrochemical response of an FAD-GDHα mutant (N177S, N215S, F353L, F406L) of the present invention, varying concentrations of glucose (shown as a rhombus). FIG. 26B shows a bioelectrochemical response of an FAD-GDHα mutant (N177S, N215S, F353L, F406L) of the present invention to glucose and the non-linear fit through which $K_m$ (k) and $V_{max}$ have been calculated. The enzyme activity of FAD-GDHα (N177S, N215S, F353L, F406L) was determined by immobilizing FAD-GDHα (N177S, N215S, F353L, F406L) to a carbon electrode by an electropolymerization method without the addition of an electron mediator.

FIG. 27A shows an exemplary embodiment of the present invention, showing a biochemical response of FAD-GDHα (N177S, N215S, F353L, F406L) to varying concentrations of glucose (shown as a rhombus), maltose (shown as a triangle), an xylose (shown as a rectangle). FIG. 27B shows the biochemical response of FAD-GDHα (N177S, N215S, F353L, F406L) to glucose and the non-linear fit through which $K_m$ (k) and $V_{max}$ have been calculated. FAD-GDHα (N177S, N215S, F353L, F406L) activity was determined by monitoring a decrease of dichlorophenolindophenol (DCIP) signal at $OD_{600}$ (Epoch Microplate Spectrophotometer, Biotek).

FIGS. 28A and 28B, show an electrochemical response to various substrates. In an exemplary embodiment, FIG. 28A shows electrochemical data representing the current response of the biosensor to various glucose concentrations (shown as a rhombus), maltose concentrations (shown as a triangle) and xylose (shown as a rectangle) concentrations. FIG. 28B shows a biosensor response to glucose and the non-linear fit through which apparent $K_m$ (k) and $V_{max}$ have been calculated. In an exemplary embodiment, wild type FAD-GDHα was immobilized to a carbon electrode via an electropolymerization method as described previously. $R^2$ represents a linear fit of the glucose data. FIG. 28B shows $K_{mapp}$=0.85 mM and Imax=1218.5 nA.

FIG. 29A shows biochemical responses of wild type FAD-GDHα (w.t.), varying concentrations of glucose (rhombus), maltose (triangle) and xylose (rectangle). FIG. 29B shows a biochemical response of wild type FAD-GDHα to glucose and the non-linear fit through which $K_m$ (k) and $V_{max}$ have been calculated. The enzyme activity of wild type FAD-GDHα was determined by monitoring the decrease of Dichlorophenolindophenol (DCIP) signal at $OD_{600}$.

Biochemical and Electrochemical comparison between a mutant according to some embodiments of the present invention and FAD-GDHα (w.t.), shown in FIGS. 27A and 27B as compared with FIGS. 29A and 29B, demonstrates that the mutant increased in specificity and activity while FIGS. 28A and 28B demonstrate the improvement in bioelectrochemical linearity behavior. Thus, these results distinguish the mutant for glucose-measurements applications over the wild type enzyme.

FIG. 30 is a table showing the results obtained from the biochemical and electrochemical experiments characterizing FAD-GDHα (N177S, N215S, F353L, F406L) where: $K_m$ is the Michaelis constant, $K_{cat}$ is the enzyme's catalytic constant, $K_{cat}/K_m$ is the catalytic efficiency, glucose/xylose is the ratio of $K_{catglu}/K_{catxyl}$, BEC linearity is the $R^2$ of the linear fit of the bioelectrochemical experiment, I20 is the current flux (nA/cm$^2$) measured when 20 mM of glucose was tested, Xylose selectivity is the ratio of $I20_{glu}/I20_{xyl}$, Maltose selectivity is the ratio of $I20_{glu}/I20_{mal}$, pos1-4, the mutated amino acid number.

FIG. 34A shows an exemplary embodiment of the present invention, showing electrochemistry data of FAD-GDHα (N177S, N215S, F353L, F406L) to varying concentrations of glucose (shown as a rhombus), using screen-printed electrodes according to some embodiments of the present invention, where the mutant FAD-GDH protein is immobilized with polypyrrole, and benzoquinone is used as a mediator to obtain a single measurement. FIG. 34B shows the non-linear fit (red line) of the data represented in FIG. 34A. $V_{max}$ refers to the maximum current flux, K refers to the apparent $K_m$ value extracted from the Michaelis menten equation.

The screen printed electrode (SPE) was activated by overlaying it with saturated potassium bicarbonate solution and applying 1.2V for 3 minutes. The electrode was washed 3 times with DDW and overlaid with immobilization solution containing 1.2 mg/ml of enzyme and 0.25 M Pyrrole-KCl solution. Electropolymerization was applied via CA 20 pulses of 0.65V, 1 second each with 5 second intervals between each pulse. Glucose sensing was conducted by dipping the immobilized enzyme SPE into a PBS solution, followed by step-wise pipetting of concentrated glucose solution to reach the depicted final glucose solution and by applying 0.2V for 5 minutes at each addition point FIG. 35A shows an exemplary embodiment of the present invention, showing electrochemistry data of FAD-GDHα (N177S, N215S, F353L, F406L) to varying concentrations of glucose (shown as a rhombus), using screen-printed electrodes according to some embodiments of the present invention, where the mutant FAD-GDH protein is immobilized with polypyrrole, to obtain a single measurement via direct electron transfer. FIG. 35B shows the non-linear fit (red line) of the data represented in FIG. 35A. $V_{max}$ refers to the maximum current flux, K refers to the apparent $K_m$ value extracted from the Michaelis menten equation.

The screen printed electrode (SPE) was activated by overlaying it with saturated potassium bicarbonate solution and applying 1.2V for 3 minutes. The electrode was washed 3 times with DDW and overlaid with immobilization solution containing 1.2 mg/ml of enzyme and 0.25 M Pyrrole-KCl solution. Electropolymerization was applied via CA 20 pulses of 0.65V, 1 second each with 5 second intervals between each pulse. Glucose sensing was conducted by dipping the immobilized enzyme SPE into a PBS solution, followed by step-wise pipetting of concentrated glucose solution to reach the depicted final glucose solution and by applying 0.2V for 5 minutes at each addition point.

FIG. 36A shows an exemplary embodiment of the present invention, showing electrochemistry data of FAD-GDHα (N177S, N215S, F353L, F406L) to varying concentrations of glucose (shown as a rhombus), using screen-printed electrodes according to some embodiments of the present invention, where the mutant FAD-GDH protein is immobilized with PEDOT, to obtain a single measurement via direct electron transfer. FIG. 36B shows the non-linear fit (red line) of the data represented in FIG. 36A. $V_{max}$ refers to the maximum current flux, K refers to the apparent $K_m$ value extracted from the Michaelis menten equation.

The printed electrode (SPE) was activated by overlaying it with saturated potassium bicarbonate solution and applying 1.2V for 3 minutes. The electrode was washed 3 times with DDW and overlaid with immobilization solution containing 1 mg/ml of enzyme and 0.01 M EDOT/PSS solution (final concentration). Electropolymerization was applied via cycles of CV ranging 0.2-0.85V with a scanning speed of 0.05V/Sec. The immobilized electrode was then washed with DDW and glucose sensing was conducted by dipping the immobilized enzyme SPE into a PBS solution, followed by step-wise pipetting of concentrated glucose solution to reach the depicted final glucose solution and by applying 0.3V for 5 minutes at each addition point.

FIG. 37A shows an exemplary embodiment of the present invention, showing electrochemistry data of FAD-GDHα (N177S, N215S, F353L, F406L) to varying concentrations of glucose (shown as a rhombus), using screen-printed electrodes according to some embodiments of the present invention, where the mutant FAD-GDH protein is immobilized with graphene oxide, to obtain a single measurement via direct electron transfer. FIG. 37B shows the non-linear fit (red line) of the data represented in FIG. 37A. $V_{max}$ refers to the maximum current flux, K refers to the apparent $K_m$ value extracted from the Michaelis menten equation.

The printed electrode (SPE) was activated by overlaying it with saturated potassium bicarbonate solution and applying 1.2V for 3 minutes. The electrode was washed 3 times with DDW and overlaid with immobilization solution containing 1 mg/ml of enzyme and 0.01 M EDOT/PSS solution (final concentration). Electropolymerization was applied via cycles of CV ranging 0.2-0.85V with a scanning speed of 0.05V/Sec. The immobilized electrode was then washed with DDW and glucose sensing was conducted by dipping the immobilized enzyme SPE into a PBS solution, followed by step-wise pipetting of concentrated glucose solution to reach the depicted final glucose solution and by applying 0.3V for 5 minutes at each addition point.

FIGS. 38A and 38B shows an exemplary embodiment of the present invention, showing electrochemistry data of FAD-GDHα (N177S, N215S, F353L, F406L), using an electrode according to some embodiments of the present invention configured to measure glucose levels continuously, for 20 hrs (FIG. 38A), or 64 hr (FIG. 38B). In this the mutant FAD-GDH protein is immobilized with polypyrrole, to obtain a single measurement via direct electron transfer.

SPE was activated by overlaying it with saturated potassium bicarbonate solution and applying 1.2V for 3 minutes. The electrode was washed 3 times with DDW and overlaid with immobilization solution containing 1.2 mg/ml of enzyme and 0.25 M Pyrrole-KCl solution. Electropolymerization was applied via Chronoamperometry (CA) by applying 20 pulses of 0.65V, 1 second each with 5 second intervals between each pulse. Glucose sensing was conducted by dipping the immobilized enzyme SPE into a PBS solution containing 5.5 mM glucose and by applying 0.2V for 20 or 64 hours (FIGS. 38A and 38B, respectively).

FIG. 39 shows an exemplary embodiment of the present invention, showing electrochemistry data of FAD-GDHα (N177S, N215S, F353L, F406L), using an electrode according to some embodiments of the present invention configured to measure glucose levels continuously, for 20 hrs. In this embodiment, the mutant FAD-GDH protein is immobilized with PEDOT, to obtain a single measurement via direct electron transfer.

SPE was activated by overlaying it with saturated potassium bicarbonate solution and applying 1.2V for 3 minutes. The electrode was washed 3 times with DDW and overlaid with immobilization solution containing 1 mg/ml of enzyme and 0.01 M EDOT/PSS solution (final concentration). Electropolymerization was applied via cycles of CV ranging 0.2-0.85V with a scanning speed of 0.05V/Sec. Electropolymerization was applied via Chronoamperometry (CA) by applying 20 pulses of 0.65V, 1 second each with 5 second intervals between each pulse. Glucose sensing was conducted by dipping the immobilized enzyme SPE into a PBS solution containing 5.5 mM glucose and by applying 0.3V for 18 hours.

FIG. 40 shows a table of electrochemistry data of the embodiments of the electrodes of the present invention.

While a number of embodiments of the present invention have been described, it is understood that these embodiments are illustrative only, and not restrictive, and that many modifications may become apparent to those of ordinary skill in the art. Further still, the various steps may be carried out in any desired order (and any desired steps may be added and/or any desired steps may be eliminated). All publications and other references mentioned herein are incorporated by reference in their entirety, as if each individual publication or reference were specifically and individually indicated to be incorporated by reference.

Publications and references cited herein are not admitted to be prior art.

REFERENCES

Wang, Joseph (2008). *Electrochemical Glucose Biosensors*. Chem. Rev. 2008, 108, 814-825.

Ferri, Stefano et al. (2011) *Review of Glucose Oxidases and Glucose Dehydrogenases: A Bird's Eye View of Glucose Sensing Enzymes*. Journal of Diabetes Science and Technology. Volume 5, Issue 5, September 2011.

SEQUENCE LISTING (153 sequences)

SEQ ID NO: 1 - protein, 550 aa, Burkholderia cepacia
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 2 - protein, 550 aa, Burkholderia lata
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCFHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 3 - protein, 549 aa, Artificial Sequence
  Synthetic construct
MADTDTQKADVVVVGSGVAGAIVAHQLAMAGKAVILLEAGPRTPRWEIVERFRNQPDKMDFMAPYPSSWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLVGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 4 - protein, 550 aa, Artificial Sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLFNLSRIDQETQKIFKAGKLMKPDELDAQIRDRSARYVQFDCFHEILPQPENRIVPNKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 5 - protein, 550 aa, Artificial Sequence; identical to SEQ ID NO: 1
  Synthetic construct

SEQ ID NO: 6 - protein, 550 aa, Artificial Sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVALTIAALALRMSDTLKKEVGSGSGHHHHHH

SEQ ID NO: 7 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGAANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPRPENCIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 8 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLTDHPGTGVSFYASEKLWPGRGPQEMTSLIGFRDGPFRATEAAKKIHLSNLSHIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 9 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCLHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 10 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCDHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 11 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCHHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 12 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCMHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 13 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCEHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 14 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCSHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 15 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCTHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 16 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCYHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 17 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCNHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 18 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCQHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 19 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCCHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 20 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCGHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 21 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCPHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 22 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCAHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 23 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCVHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 24 - protein, 550 aa, Burkholderia cepacia
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCIHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 25 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCWHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 26 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPHNHITGSTIMGADARDSVVDKDCRTFDHPNLFISSSATMPTVGTVNVTLTIAALALRMSDTLKKEVGSGSGHHHHHH

SEQ ID NO: 27 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPLNHITGSTIMGADARDSVVDKDCRTFDHPNLFISSSATMPTVGTVNVTLTIAALALRMSDTLKKEVGSGSGHHHHHH

SEQ ID NO: 28 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPSNHITGSTIMGADARDSVVDKDCRTFDHPNLFISSSATMPTVGTVNVTLTIAALALRMSDTLKKEVGSGSGHHHHHH

SEQ ID NO: 29 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPVNHITGSTIMGADARDSVVDKDCRTFDHPNLFISSSATMPTVGTVNVTLTIAALALRMSDTLKKEVGSGSGHHHHHH

SEQ ID NO: 30 - protein, 26 aa, Artificial Sequence
  Synthetic Constructs
CCAGGCAAATTCTGTTTTATCAGACC

SEQ ID NO: 31 - protein, 23 aa, Artificial Sequence
  Synthetic Constructs
CAAGCTGGAGACCGTTTAAACTC

SEQ ID NO: 32 - protein, 26 aa, Artificial Sequence
  Synthetic Constructs
CGCTATTCAGATCCTCTTCTGAGATG

SEQ ID NO: 33 - protein, 24 aa, Artificial Sequence
  Synthetic Constructs
GCTTCTGCGTTCTGATTTAATCTG

SEQ ID NO: 34 - protein, 37 aa, Artificial Sequence
  Synthetic Constructs
GGTCGTGGTCGGATCCGGTGTGGCAGGTGCTATTGTG

SEQ ID NO: 35 - protein, 23 aa, Artificial Sequence
  Synthetic Constructs
CGTTCTTATTGCCCGAATAAACC

SEQ ID NO: 36 - protein, 21 aa, Artificial Sequence
  Synthetic Constructs
CGAAGAAGCCCTGATGTTTGG

SEQ ID NO: 37 - protein, 25 aa, Artificial Sequence
  Synthetic Constructs
GAAGCATGGTATCTGGGCATTGTTG

SEQ ID NO: 38 - protein, 539 aa, Burkholderia cepacia
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 39 - protein, 539 aa, Burkholderia lata
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCFHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 40 - protein, 538 aa, Artificial sequence
  Synthetic construct
MADTDTQKADVVVVGSGVAGAIVAHQLAMAGKAVILLEAGPRTPRWEIVERFRNQPDKMDFMAPYPSSWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLVGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 41 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLFNLSRIDQETQKIFKAGKLMKPDELDAQIRDRSARYVQFDCFHEILPQPENRIVPNKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 42 - protein, 539 aa, Burkholderia cepacia; identical to SEQ ID NO: 38

SEQ ID NO: 43 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVALTIAALALRMSDTLKKEV

SEQ ID NO: 44 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGAANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPRPENCIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 45 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLTDHPGTGVSFYASEKLWPGRGPQEMTSLIGFRDGPFRATEAAKKIHLSNLSHIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 46 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCLHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 47 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCDHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 48 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCHHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 49 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCMHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 50 - protein, 539 aa, Burkholderia cepacia
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCEHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 51 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCSHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 52 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCTHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 53 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCYHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 54 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCNHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 55 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCQHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 56 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCCHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 57 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCGHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 58 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCPHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 59 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCAHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 60 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCVHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 61 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCIHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 62 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCWHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEV

SEQ ID NO: 63 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPHNHITGSTIMGADARDSVVDKDCRTFDHPNLFISSSATMPTVGTVNVTLTIAALALRMSDTLKKEV

SEQ ID NO: 64 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPLNHITGSTIMGADARDSVVDKDCRTFDHPNLFISSSATMPTVGTVNVTLTIAALALRMSDTLKKEV

SEQ ID NO: 65 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPSNHITGSTIMGADARDSVVDKDCRTFDHPNLFISSSATMPTVGTVNVTLTIAALALRMSDTLKKEV

SEQ ID NO: 66 - protein, 539 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPVNHITGSTIMGADARDSVVDKDCRTFDHPNLFISSSATMPTVGTVNVTLTIAALALRMSDTLKKEV

SEQ ID NO: 67 - protein, 550 aa, Burkholderia lata
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCAHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 68 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCCHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 69 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCDHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 70 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCEHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 71 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCGHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 72 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCHHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 73 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCIHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 74 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCKHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 75 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCLHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 76 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCMHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 77 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCNHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 78 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCQHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 79 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCSHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 80 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCPHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 81 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCVHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 82 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCRHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 83 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCTHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 84 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCWHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 85 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCYHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 86 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCAHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 87 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCCHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 88 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCDHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 89 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCEHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 90 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCGHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 91 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCHHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 92 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCIHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 93 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCKHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 94 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCLHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 95 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCMHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 96 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCNHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 97 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCQHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 98 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCSHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 99 - protein, 539 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCPHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEV

SEQ ID NO: 100 - protein, 544 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCVHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSG

SEQ ID NO: 101 - protein, 544 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCRHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSG

SEQ ID NO: 102 - protein, 544 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCTHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSG

SEQ ID NO: 103 - protein, 544 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCWHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSG

SEQ ID NO: 104 - protein, 544 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCYHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSG

SEQ ID NO: 105 - protein, 550 aa, Artificial Sequence
  Synthetic Construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGDNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 106 - protein, 550 aa, Artificial Sequence
  Synthetic Construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGGNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 107 - protein, 550 aa, Artificial Sequence
  Synthetic Construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGHNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 108 - protein, 550 aa, Artificial Sequence
  Synthetic Construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGTNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 109 - protein, 550 aa, Artificial Sequence
  Synthetic Construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGYNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 110 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFSEQTIKTALNNYDPKFHVVTEPVARNSRPYDGRPTCCGSNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPLRATEAAKKIHLSNLSRIDQETQKIFKAGKLMKPDELDAQIRDRSARYVQFDCLHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 111 - protein, 550 aa, Artificial sequence
  Synthetic Construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFSEQTIKSALNGYDPKFHVVTEPVARNSRPYDGRPTCCGSNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPLRANEAAKKIHLSNMSRINQETQKIFKGGKLMKPEELDAQIRDRSARFVQFDCLHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 112 - protein, 550 aa, Artificial sequence
  Synthetic Construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGSNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCFHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 113 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGTNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCFHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 114 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFSEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 115 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFSEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCFHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 116 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPLRATEAAKKIHLSNLSRIDQETQKIFKAGKLMKPDELDAQIRDRSARYVQFDCFHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 117 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPLRANEAAKKIHLSNMSRINQETQKIFKGGKLMKPEELDAQIRDRSARFVQFDCFHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 118 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFSEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCLHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 119 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFSEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCLHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 120 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPLRATEAAKKIHLSNLSRIDQETQKIFKAGKLMKPDELDAQIRDRSARYVQFDCLHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 121 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPLRANEAAKKIHLSNMSRINQETQKIFKGGKLMKPEELDAQIRDRSARFVQFDCLHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 122 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGSNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCLHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 123 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGSNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCLHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 124 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFSEQTIKTALNNYDPKFHVVTEPVARNSRPYDGRPTCCGNNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPLRATEAAKKIHLSNLSRIDQETQKIFKAGKLMKPDELDAQIRDRSARYVQFDCLHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 125 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFSEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPLRANEAAKKIHLSNMSRINQETQKIFKGGKLMKPEELDAQIRDRSARFVQFDCLHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 126 - protein, 550 aa, Artificial sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFSEQTIKTALNNYDPKFHVVTEPVARNSRPYDGRPTCCGSNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPFRATEAAKKIHLSNLSRIDQETQKIFKAGKLMKPDELDAQIRDRSARYVQFDCLHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 127 - protein, 550 aa, Artificial sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFSEQTIKSALNGYDPKFHVVTEPVARNSRPYDGRPTCCGSNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCLHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 128 - protein, 550 aa, Artificial Sequence
  Synthetic construct
MADTDTQKADVVVVGSGVAGAIVAHQLAMAGKAVILLEAGPRMPRWEIVERFRNQPDKMDFMAPYPSSPWAPHPEYGPPNDYLILKGEHKFNSQYIRAVGGTTWHWAASAWRFIPNDFKMKSVYGVGRDWPIQYDDLEPYYQRAEEELGVWGPGPEEDLYSPRKQPYPMPPLPLSFNEQTIKTALNNYDPKFHVVTEPVARNSRPYDGRPTCCGSNNCMPICPIGAMYNGIVHVEKAERAGAKLIENAVVYKLETGPDKRIVAALYKDKTGAEHRVEGKYFVLAANGIETPKILLMSANRDFPNGVANSSDMVGRNLMDHPGTGVSFYASEKLWPGRGPQEMTSLIGFRDGPLRATEAAKKIHLSNLSRIDQETQKIFKAGKLMKPDELDAQIRDRSARYVQFDCLHEILPQPENRIVPSKTATDAIGIPRPEITYAIDDYVKRGAAHTREVYATAAKVLGGTDVVFNDEFAPNNHITGSTIMGADARDSVVDKDCRTFDHPNLFISSSATMPTVGTVNVTLTIAALALRMSDTLKKEVGSGSGHHHHHH

SEQ ID NO: 129 - protein, 550 aa, Artificial Sequence
  Synthetic construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGSNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPLRANEAAKKIHLSNMSRINQETQKIFKGGKLMKPEELDAQIRDRSARFVQFDCLHEILPQPENRIVPSKTATDAVGIPRPEITYAIDDYVKRGAVHTREVYATAAKVLGGTEVVFNDEFAPNNHITGATIMGADARDSVVDKDCRAFDHPNLFISSSSTMPTVGTVNVTLTIAALALRMSDTLKKEVGSGSGHHHHHH

SEQ ID NO: 130 - protein, 534 aa, Artificial Sequence
  Recombinant construct
MSNLNSADVVVIGAGVTGALLATRLAKTGKSVLLLESGPRMGRDQLVERFRSSAFKSDFMAPYPYSPLAPHPRYTPEPNGYLQQKGPHAFNAQYIRMFGGTSWHWAAQLWRYVPNDFRQHSLYGVGKDWPISYDDLEDYYYQAEVIAGVGGSPESGSPRKHPFPMERVPASWLQQRVTARLAPEFTVLDDSTGRNSRNYDGRPACCGNNNCMPLCPIDAQYHGGLAAQQAEDSGVKVITEAVVYRLEHDEKGRIAAAHYYDWNKVSHRITAQTFVLAANAIETPKLLLMSISDRFPQGIANARDNVGRNLCDHPAIGVSFDVDEEIWPGRGPVSPCSIGQFRDGDFRAEHAPFRIDISNASQVAAVTKEVVAEGYFGKRLEEQILFRAARRLSIKNALEQLPDRNNRVTLGDKKDELGLPVPALYWNVDDYVIKGTEQTRACYDAIAAKLGATNIKHSKSGAFSNRQHITGTLSMGLDPATSVTDAWGRAHDHENLFMVGTGVMPTVGTCNVTLTAMALALRTADKIIEESRHA

SEQ ID NO: 131 - protein, 533 aa, Artificial Sequence
  Synthetic Construct
MANANSADVVVVGSGVAGSLVAHQMALAGASVILLEAGPRLQRGQIVENFRNSPAKSDFATPYPSTPYAPHPQYSPANNYLIQKGDYPYDSQYVRLVGGTTWHWAAATWRLLPSDFQLKKLYGVGRDWPYPYETLEPWYYAAEVQLGVSGPDATVDLGSPRSKPYPMTALPLSYMDQRFSVVLNANGFKVVPEPVARNSRPYDARPTCCGNNNCMPICPIGAMYNGIVHADKAERAGAKLIAQAVVYRVEADNKGLITAVHYKDPNGNSTRVTGKLFVLAANGIETPKLMLMSTSDTFPHGIGNSSDQVGRNLMDHPGTGVTFLANESLWPGRGPMEMTSVVNFRDGAFRSEYASKKLHVSNGVPTMAITSALLKGGLTGAELDRQIRDRAARMVTINSFHEHLPEPQNRIVPSADHKDALGIAQPEIYYSINDYVKKSAAHTHELYAQIAGLFGGTEVSFDDTFAPNNHIMGTTIMGNDAASSVVDADCRTHDHPNLFIASSGVMPGAASVNCTLTIAALSLKLADKLKREI

SEQ ID NO: 132 - protein, 527 aa, Artificial Sequence
  Recombinant construct
MAETQRADFVVVGSGVAGALVAHQLALAGKDVLILEAGPRMARWEIVERFRNQADKSDNQAPYPASRQAPHPQFHPDNHYLIQKGTHPYDVQYLRVVGGTTWHWAASAWRFLPNDLKLASLYGVGRDWPIEYAELEPWYQRAEEELGVWGPGDEELDSPRSQPYPMPPLPLSWNEQRIKTLLNANGYRVVTEPVARNSRPYDARPTCCGNNNCMPICPIGAMYNGIVHVEKAESAGARLVDNAVVFKLEKGDGGKIGAALYKDPQGNEHRVEGGTFILAANGIETPKLMLMSEVGNSSDMVGRNLMDHPGTAVQFYADEKLWPGRGPQEMTSMVGFRDGAFRSEYASKKIHLSNLSRTDQVAAELIRKGPLLLGRELEAQIRDRAARFVRFDSFHEILPHPENRIVPSTSERDAVGIAKPEFTYAMDDYVRRSAVHTREVYTHAAKLLGGSEVVFEDNFANNNHITGTTLMGADPKDSVVDAQCRSHDHPNLFIASSGVMPTVGSVNCTLTIAALALRLAEHLKREA

SEQ ID NO: 133 - protein, 544 aa, Artificial Sequence
  Recombinant construct
MADTLKADIVVIGSGVAGGLVAHQLAMAGKSVLVLEAGPRLSRWEIVENFRNQPDKSDNMAPYPSTSYAPHPESNPNNNYLIQKGEHPYDVQYIRAVGGTTWHWAASAWRFLPNDFKLKTLYGVGRDWPIEYAALEKWYLRAEQELGVWGPSDEELGSPRSEPYPMAPLPLSWNEQRIKTVLNSNRFTGSGFTDAHFNVVTEPVARNSRPYDGRPTCCGNNNCMPICPIGAMYNGITHVEKAELAGAIVRPQAVVYKLEVNDQQQITAALFKDAQGNQHRAEGKFFVLAANGIEIPKLMLMSTSEKNPHGVGNSSDMVGRNLMDHPGTGVTFMASEPLWPGRGPQEMTSMVGFRDGAFRADFAAKKIHLSNLSRTDQVTIELLKQGDLQLGPQLEAKIRDRAARFVQFDSFHEILPHVENRIIPSSTEKDAIGIPKPEFYYAMDDYVRKSAVHTQQIYAEAARLMGGTEIKFNNNFANNNHITGTTIMGDDPKDSVVDSDCRTHDHKNLFIASSSVMPTVGSVNCTLTIAALSLRIAETLKTEV

SEQ ID NO: 134 - protein, 536 aa, Artificial Sequence
  Recombinant construct
MADTQQADIVVVGSGVAGALVAYELARAGKSVLMLEAGPRLPRWEIVERFRNQADKMDFMAPYPSTPWAPHPEYGPPNNYLVLKGEHQFNSQYIRAVGGTTWHWAASTWRFLPNDFKLRSVYGIARDWPIQYQDLERYYGRAEEALGVWGPNDEDLGSPRSQPYPMAPLPLSFSERTIKDALNAHDASLHVVTEPVARNSRPYDGRPTCCGNNNCMPICPIGAMYNGIVHVEKAEQAGARLIENAVVFKLEVGPNKRIVAARYKDSKGAEHRVEGKWFVLAANGIETPKLMLMSTSQDFPKGVGNSSDMVGRNLMDHPGTGVSFYADRKLWPGRGPQEMTSLIGFRDGPFRATQAGKKLHLSNMSRIEQETQRIFKEGKLIKPAELDARIRDQAARYVQFDSFHEILPLPENRIVPSASEVDAIGIPRPEITYHIDDYVKRSAVHTREVYATAAQVMGGTNVEFHDDFAPNNHITGATIMGADPKNSVVDKDCRTFDHPNLFISSSSTMPTVGTVNVTLTIAALALRIADQLKKEA

SEQ ID NO: 135 - protein, 539 aa, Artificial Sequence
  Recombinant construct
MPDIATQKADVIVVGSGVAGSIVAHQLALAGKSVILLEAGPRMPRWEIVERFRDQPDKTDFMAPYPSSAWAPHPEYGPPNDYLILKGEHKFNSQYIRAVGGTTWHWAASAWRFIPNDFMMKTVYGVGRDWPIQYDDLEHYYQRAEEELGVWGPGPEEDLYSPRNRPYPMPPLPLSFNEQTIKTALNGYNPKFNVVTEPVARNSRPYDGRPTCCGNNNCMPICPIGAMYNAIVHVEKAEQAGAKLIENAVVYRLETAPNKRITAAVYKDKTGAEHRVEGKYFVVAANGIETPKILLLSANRDFPNGVANSSGMVGRNLMDHPGTGVSFYSSEKLWPGRGPQEMTSLIGYRDGPFRATEAAKKIHLSNMSRINQETEKLFKGGTLMKSEELDARIRDRSARYVQFDCFHEMLPSPENRIVPSTTATDAIGIPRPEITYAIDDYVKRGAAHTREIYATAAKVLCGTDVVFNDEFAPNNHITGATIMGAEARDSVVDKDCRTFDHPNLFISSSSTMPSVGTVNVTLTIAALALRMADTLKKEV

SEQ ID NO: 136 - protein, 539 aa, Artificial Sequence; identical to SEQ ID NO: 38
  Recombinant construct

SEQ ID NO: 137 - protein, 539 aa, Artificial Sequence
  Recombinant construct
MADTDTQKADIVVVGSGVAGAIVAHQLAMAGKSVILLEAGPRMPRWEIVERFRNQADKTDFMAPYPSSPWAPHPEYGPPNDYLVLKGEHKFNSQYIRAVGGTTWHWAASAWRFIPNDFKMKTVYGVGRDWPIQYDDLEHYYQRAEEELGVWGPGPEEDLYSPRKQAYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAIYKDKTGADHRVEGKYFVIAANGIETPKILLMSANRDFPNGVANSSDMVGRNLMDHPGTGVSFYASEKLWPGRGPQEMTSLIGFRDGPFRATEAAKKIHLSNMSRINQETQKIFKAGKLMKHDELDAQIRDRSARYVQFDCFHEILPQPENRIVPSKTATDAIGIPRPEITYAIDDYVKRGAVHTREVYATAAKVLGGTDVVFNDEFAPNNHITGATIMGADARDSVVDKDCRTFDHPNLFISSSSTMPTVGTVNVTLTIAALALRMSDTLKKEV

SEQ ID NO: 138 - protein, 539 aa, Artificial Sequence
  Recombinant construct
MADTDTQKADIVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRANEAAKKIHLSNMSRINQETQKIFKGGKLMKPEELDAQIRDRSARFVQFDCFHEILPQPENRIVPSKTATDAVGIPRPEITYAIDDYVKRGAVHTREVYATAAKVLGGTEVVFNDEFAPNNHITGATIMGADARDSVVDKDCRTFDHPNLFISSSSTMPTVGTVNVTLTIAALALRMSDTLKKEV

SEQ ID NO: 139 - protein, 539 aa, Artificial Sequence
  Recombinant construct
MADTDTQKADVVVVGSGVAGAIVAHQLAMAGKSVILLEAGPRMPRGEIVERFRNQPDKTDFMAPYPSSPWAPHPEYGPPNDYLVLKGEHKFNSQYIRAVGGTTWHWAASAWRFIPNDFKMKTVYGVGRDWPIQYDDLEHYYQRAEEELGVWGPGPEEDLYSPRKQPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRIVAAIYKDKTGADHRVEGKYFVVAANGIETPKILLMSANRDFPNGVANSSDMVGRNLMDHPGTGVSFYASDKLWPGRGPQEMTSLIGFRDGPFRATEAAKKIHLSNMSRINQETQKIFKAGKLMKSDELDAQIRDRSARYVQFDCFHEILPQPENRIVPSKTATDAIGIPRPEITYAIDDYVKRGAVHTREVYATAAKVLGGTEVVFNDEFAPNNHITGATIMGADARDSVVDKDCRTFDHPNLFISSSSTMPTVGTVNVTLTIAALALRMSDTLKKEV

SEQ ID NO: 140 - protein, 539 aa, Artificial Sequence
  Recombnant construct
MADTDTQKADVVVVGSGVAGAIVAHQLAMAGKSVILLEAGPRMPRWEIVERFRNQPDKTDFMAPYPSSPWAPHPEYGPPNDYLILKGEHKFNSQYIRAVGGTTWHWAASAWRFIPNDFKMKTVYGVARDWPIQYDDLEHWYQRAEEELGVWGPGPEEDLYSPRKQAYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRIVAAIYKDKTGADHRVEGKYFVLAANGIETPKILLMSANRDFPNGVANSSDMVGRNLMDHPGTGVSFYANEKLWPGRGPQEMTSLIGFRDGPFRATEAAKKIHLSNMSRINQETQKIFKAGKLMKHEELDAQIRDRSARYVQFDCFHEILPQPENRIVPSKTATDAIGIPRPEITYAIDDYVKRGAVHTREVYATAAKVLGGTDVVFNDEFAPNNHITGATIMGADARDSVVDKDCRTFDHPNLFISSSSTMPTVGTVNVTLTIAALALRMSDTLKKEV

SEQ ID NO: 141 - protein, 539 aa, Artificial Sequence
  Recombinant construct
MADTDTQKADVVVVGSGVAGAIVAHQLAMAGKSVILLEAGPRMPRWEIVERFRNQVDKTDFMAPYPSSAWAPHPEYGPPNDYLILKGEHKFNSQYIRAVGGTTWHWAASAWRFIPNDFKMKTVYGVGRDWPIQYDDIEHYYQRAEEELGVWGPGPEEDLYSPRKEPYPMPPLPLSFNEQTIKSALNGYDPKFHVVTEPVARNSRPYDGRPTCCGNNNCMPICPIGAMYNGIVHVEKAEQAGAKLIDSAVVYKLETGPDKRITAAVYKDKTGADHRVEGKYFVIAANGIETPKILLMSANRDFPNGVANSSDMVGRNLMDHPGTGVSFYANEKLWPGRGPQEMTSLIGFRDGPFRATEAAKKIHLSNMSRINQETQKIFKAGKLMKPEELDAQIRDRSARYVQFDCFHEILPQPENRIVPSKTATDAIGIPRPEITYAIDDYVKRGAVHTREVYATAAKVLGGTEVVFNDEFAPNNHITGATIMGADARDSVVDKDCRTFDHPNLFISSSSTMPTVGTVNVTLTIAALALRMSDTLKKEV

SEQ ID NO: 142 - protein, 535 aa, Artificial Sequence
  Recombinant sequence
DTQQADVVVVGSGVAGAIVAHQLATAGKSVILLEAGPRMPRWEIVERFRNQPDKMDFMAPYPSSPWAPHPEYGPPNDYLVLKGEHKFNSQYIRAVGGTTWHWAASAWRFIPNDFKMKTVYGVGRDWPIQYDELEHYYQRAEEELGVWGPGAEEDLLSPRKQPYPMPPLPLSYNEQTIKTALNNHDPKYHVVTEPVARNSRPYDGRPTCCGNNNCMPICPIGAMYNGIVHVEKAEQAGAKLIENAVVHKLEVGPQKKIVAALYKDPKGVEHRVEGKYFVLAANGIETPKLMLMSTSHDFPNGVGNRSDMVGRNLMDHPGTGVSFYASEKLWPGRGPQEMTSLIGFRDGAFRATEAAKKIHLSNLSRIDQETQKIFKAGKLMKPAELDAQIRDRSARYVQFDCFHEILPQPENRIVPSKTATDAIGIPRPEITYAIDDYVKRGAVHTREVYATAAKVLGGTDVAFNDEFAPNNHITGATIMGADPRDSVVDKDCRTFDHPNLFVSSSATMPTVGTVNVTLTIAALALRISDQLKKEI

SEQ ID NO: 143 - protein, 540 aa, Artificial Sequence
  Recombinant construct
MADKQQSTEQADIVVVGSGVAGAIVAHQLAQAGKSVILLEAGPRMPRWEIVERFRNQADKMDFMAPYPPSKWAPHPEYYPPNNYLILKGEHKFNSQYIRAVGGTTWHWAASAWRFMPNDFRMKTVYGVGRDWPMQYEELEPYYQRAEEELGVWGPTDEELGSPRSQPYPMAPLPLSYNEQTIKSKLNAFDSRYHVVTEPVARNSRPYDGRPTCCGNNNCMPICPIGAMYNGIVHVEKAEQAGARLIANAVVYKLEVGTDKRITAALYKDAQGNEHRVEGKYFVLAANGIETPKIMLMSQSHDFPNGVGNSSDMVGRNLMDHPGTGVTFYADEKLWPGRGPQEMTSLIGFRDGAFRATEAAKKIHLSNMSRVDQETQKIFKQGKLIKPAELDAQIRDRSARFVEFDCFHEILPQPENRIVPSRTETDAIGIARPEITYRIDDYVKRGAAHTREVYANAAKVLGGSDIRFDDEFAPNNHITGATIMGSDPRDSVVDKHCRTFDHPNLFISSSATMPTVGTVNVTLTIAALALRMADQLKKEV

SEQ ID NO: 144 - protein, 534 aa, Artificial Sequence
  Recombinant construct
DTLQADIVVVGSGVAGALVAHQLALAGKSVIMLEAGPRLPRWEIVERFRNQFDKMDFMAPYPSTPWAPHPEYGPPNNYLILKGEHKFNSQYIRAVGGTTWHWAASAWRFIPNDFKMNTVYGVARDWPIQYDDVEPWYYRAEQELGVWGPNDEDLYSPRKAPYPMAPLPLSYNEATIKSKLNAYDAAYHVVTEPVARNSVPYDGRPTCCGNNNCMPICPIGAMYNGIVHVEKAEMAGAKLIDNAVVYRLEVGSNKRIVAALYKDPQGISHRVEGKYFVLAANGIETPKIMLMSTSHDFPNGVGNSSDMVGRNLMDHPGTGVSFYADEKLWPGRGPQEMTSLIGFRDGAFRSQQAAKKIHLSNLSRIDQETQKIFGQKKLLKPADLDAQIRDRSARYVQFDCFHEILPQPENRIVPSRTETDAIGIPRPEITYAIGDYVKRGAAHTREVYATAAKVLGGTEVEFHDDFAPNNHITGSVIMGSDPRNSVVDKDCRTFDHPNLFVSSSATMPTVGTVNVTLTIAALALRMADQLKKEV

SEQ ID NO: 145 - protein, 533 aa, Artificial Sequence
  Recombinant construct
DTQQADIVVVGSGVAGALVAYELARAGKSVLMLEAGPRLPRWEIVERFRNQADKMDFMAPYPSTSWAPHPEYGPPNNYLILKGEHKFNSQYIRAVGGTTWHWAASTWRFLPNDFKLRSVYGIARDWPLQYSDLERYYGRAEEALGVWGPNDEELGSPRSQPYPMTPLPLSFNERTIKEALNGYDPDFHVVTEPVARNSRPYDGRPTCCGNNNCMPICPIGAMYNGIFHVEKAEQAGARLIENAVVFKLEVGANKRIVAARYKDAKGVEHRVEGKWFVLAANGIETPKLMLMSTSQDYPKGVGNSSDMVGRNLMDHPGTGVSFYADRKLWPGRGPQEMTSLIGFRDGPFRATQAGKKLHLSNISRIEQETQRIFKEGKLIKPAELDARIRDQAARFVEFDSFHEILPLPENRIVPSATEVDAIGIPRPEITYRIDDYVKRSAVHTRQVYATAAKVLGGTDVQFNDDFAPNNHITGATIMGADPKDSVVDKDCRTFDHPNLFISSSSTMPTVGTVNVTLTIAALALRIADQLKKE

SEQ ID NO: 146 - protein, 533 aa, Artificial Sequence
  Recombinant construct
DTQQADIVVVGSGVAGALVAYELARAGKSVLMLEAGPRLPRWEIVERFRNQADKMDFMAPYPSTPWAPHPEYGPPNNYLVLKGEHQFNSQYIRAVGGTTWHWAASTWRFLPNDFKLRSVYGIARDWPIQYQDLERYYGRAEEALGVWGPNDEDLGSPRSQPYPMAPLPLSFSERTIKDALNAHDASLHVVTEPVARNSRPYDGRPTCCGNNNCMPICPIGAMYNGIVHVEKAEQAGARLIENAVVFKLEVGPNKRIVAARYKDSKGAEHRVEGKWFVLAANGIETPKLMLMSTSQDFPKGVGNSSDMVGRNLMDHPGTGVSFYADRKLWPGRGPQEMTSLIGFRDGPFRATQAGKKLHLSNMSRIEQETQRIFKEGKLIKPAELDARIRDQAARYVQFDSFHEILPLPENRIVPSASEVDAIGIPRPEITYHIDDYVKRSAVHTREVYATAAQVMGGTNVEFHDDFAPNNHITGATIMGADPKNSVVDKDCRTFDHPNLFISSSSTMPTVGTVNVTLTIAALALRIADQLKKE

SEQ ID NO: 147 - protein, 531 aa, Artificial Sequence
  Recombinant construct
QQADIVVVGSGVAGALVAYELARAGKSVLMLEAGPRLPRWEIVERFRNQADKMDFMAPYPSTPWAPHPEYGPPNNYLVLKGEHQFNSQYIRAVGGTTWHWAASTWRFLPNDFKLRSVYGIARDWPIQYQDLERYYGLAEEALGVWGPNDEDLGSPRSQPYPMTPLPLSFSERTIKDALNAHDASFHVVTEPVARNSRPYDGRPTCCGNNNCMPICPIGAMYNGIVHVEKAEQAGARLIENAVVFKLEVGPNKRIVAARYKDSKGAEHRVEGKWFVLAANGIETPKLMLMSTSQDFPKGVGNSSDMVGRNLMDHPGTGVSFYADRKLWPGRGPQEMTSLIGFRDGPFRATQAGKKLHLSNISRIEQETQRIFKEGKLIKPADLDARIRDQAARYVQFDSFHEILPLPENRIVPSATEVDAIGIPRPEITYHIDDYVKRSAVHTREVYATAAQVMGGTNVEFHDDFAPNNHITGATIMGADPKDSVVDKDCRTFDHPNLFISSSSAMPTVGTVNVTLTIAALALRIADQLKKE

SEQ ID NO: 148 - protein, 538 aa, Artificial Sequence
  Recombinant construct
MADTRQAEQADIVVVGSGVAGALVAYELARAGKSVLLLEAGPRLPRWEIVERFRNQADKMDFMAPYPSTPWAPHPEYGPPNNYLILKGEHPFDSQYIRAVGGTTWHWAASTWRFLPNDFKLRSVYGIARDWPLQYDDLERYYGQAEAALGVWGPNDEDLGSPRSRPYPMAPLPLSFNERTIKEALNAHDPAFHVVTEPVARNSRPYDGRPTCCGNNNCMPICPVGAMYNGIVHVEKAEQAGARLIENAVVYKLEVGAGKRIVAAHYKDPKGVDHRVEGKWFVLAANGIETPKLMLMSTSAAFPRGVGNSSDMVGRNLMDHPGTGVSFYADRKLWPGRGPQEMTSLIGFRDGPFRATQAGKKLHLSNISRIEQETARIFKAGKLLKPAELDARIRDQAARYVQFDSFHEILPLPENRIVPSATETDALGIPRPEITYRIDDYVKRSAVHTREVYATAAKVLGGTDVQFHDDFAPNNHITGATIMGADPKDSVVDKNCRTFDHPNLFISSSATMPTVGTVNVTLTIAALALRIADQLKKE

SEQ ID NO: 149 - protein, 528 aa, Artificial Sequence
  Recombinant construct
SDSLNADVVVIGAGIAGSLAALKMVQAGASVLMLESGPEIKRDEAVELFRNSPFKGDFTEPFPPEPWAPQPKFIPTDNNYLIQKGPDPYRAQYLRGVGGTTWHWAGQAFRLLPNDMRMKTLYGVGRDWPIGYEQLEPYYCEAEYQMGVSGDSELDSPRSRPYPLPGIPLPYGFERLKQRIAGLGYEVGIGPQARNSVPYDGRPACCGNNNCMPVCPIDAQYHGGISANKALAAGARIIANAVVHRIEANDQGQIVAVHYLDRNKVSHRVTGKRFVLTANGIESPKILLISTSERYPNGIANSSSMVGRNLMDHPGSSVEFYADEPVWFGRGPMRPGSINNLRDGAFRAERSALRVDVSNTSPVRYLTERLIRQGYYGKALNDKLAFQSERYVQLKCLLEMLPEPENRVQLSKTEKDAWGIPRLEVYYKFPEYVHRGYDQSMLDFQRIVKQMGGSEAIYSKRGLYDNNQHITGTMIMGRSGSDSVVDGDCRSHDHPNLFIAGTGVMPSASTVNSTLTGVALALHMADRV

SEQ ID NO: 150 - protein, 542 aa, Artificial Sequence
  Recombinant construct
MPSEENLSADVVIVGSGVAGSSIANELARAGISVIVLEAGPRVDRQHFVENFRNLENKPSYQGPFPAVPWARHPPDQQTPNEYLHTSGPNAEAYQQVYLRMMGGTTWHWAGCAWRYLPSDFELKTRYGQGRDWALTYDDLEPFYYQAEVMMGVCGPDPAVEDLGSPRKQPYPMDALPISYAAQQFRKLIQEKTPWRVVHEPQARNTRPYDNRPTCEGHNNCMPICPIGAMYNGSYSVYHAEAAGAKFIPNAVVYKIERDSANKRVTAVHYFDPDKGSHRVTGKYFVIAAHCIETAKLLLLSADEQSPDGVANSSGHVGRNMMDHTGVQVTFVSGDQALWPGRGPLETNVIDNFRDGNWRTDRGAYLVHMVDDNQVDLATQLAISKGYVGRELEEQIRYLASHTVRLFSHNEALPDPDNRLTLSKDHKDILGIPHPEVYYKLPEYTVRSCEHTRYVFRDLIKLMHGTDEQWTPGYFPQDHPAGSTIMGTDPKDSVVDGHCRTHDHDNLFIASSSVFSTVGTGNITLTVAALALRVADTLKKEL

SEQ ID NO: 151 - protein, 528 aa, Artificial Sequence
  Recombinant construct
SDSLSADVVVIGAGIAGSLAALKMAKAGASVLMLESGPEIKRDQVVEYFRNSPFKGDFTEPYPPQPWAPQPKFIPSDNNYLIQKGPDPYRAQYLRGTGGTTWHWAGQAFRLLPNDMRIQSLYGIGRDWPISYDELEPYYCDAEYQMGVSGDSDLASPRSRPYPLPGIPLPYGFDRLKQRLGPLGYEVGIGPQARNSIAYDGRPACCGNNNCMPVCPIDAQYHGGIAARKALDAGVKIVTNAVVFRIEADDKGTIQAVHYLDQNKARHRVTGKQFVLTANGIESPKILLLSTSDRYPNGIANSSGMVGRNLMDHPGSSVEFYADEPVWFGRGPMRPGSINNMRDGDFRGERSALRIDLANTSPVRYLTERLVRQGYYGKALNDKLAFQAERFVQLKCLLEMLPEPQNRVTLSKTEKDAWGIPRLEVYYSFPEYVHRGYDQSMIDFQRMVKEMGGTEAVYSKRGVYDNNQHITGTMIMGSNPQDSVVDGHCRTHDHPNLFIAGTGIMPSASTVNSTLTGTALALRMADSV

SEQ ID NO: 152 - protein, 533 aa, Artificial Sequence
  Recombinant construct
SETITTDIVVIGSGVVGALTARKLALAGRQVLMLEAGPRIERDTIVSNFRHSARKDDFIAPYPNSKIAPFPDYKPEDNGYLDQTGPKDYKPEYLRVVGGTSWHWAAQAWRLVPADFRLKSQYGVGRDWPISYDDLEPYYYEAELLWGVSGPPEMAKYSPRKQPFPMPPVTKSWLEQRITERLAPKYEVLTNTTGRNSRPYDGRPQCCGNNNCMPICPIDAQYHGGIAADAAEKAGVKLLPQAVVYKLEQDGKGKITAVHYYDWNKQSHRVEAEIVVLAANAVETPKILFMSADAKNPHGLCNNYDQLGRNLMDHPSNSVTFFADEPLWPGRGPMSPSSIQQLRDGAFRSESAAFRIDISNSSRVAGVTAGAIKEGLTGQALDDAIRFRASHELSFKNVLEQLPDPNNRTMLSTTKKDALGLPTPAFSYSFDSYVEKGMQHSLAVYAEIAKMLGATNVRYSTPGVYSNNQHITGTLAMGFDEKTSVTDHHGKAWEYDNLYMVSTGVMPTVATANSTLTACALGLRTADAILGKI

SEQ ID NO: 153 - protein, 542 aa, Artificial Sequence
  Recombinant construct
MSSEHNLSADVVIVGSGVAGSSIANELARAGISVIVLEAGPRVDRQHFVENFRNLENKPSYQGPFPSVPWAIHPPNQITPNEYLHTTGPDAEAYQQVYLRMMGGTTWHWAGCAWRYLPSDFELKSRYGQGRDWALKYEDLEPFYYQAEVMMGVCGPDPSVEDLGSPRQQPYPMEALPISYAAQQFRKLISEKTPWRVVHEPQARNTRPYDNRPTCEGHNNCMPICPIGAMYNGSYSVYHAEAAGAKFIPNAVVYRIERDSANKRVTAVHYYDPDKGSHRVTGKYFVIAAHCIETAKLLLVSADEQSPDGIANSSGHVGRNMMDHTGVQVSFISGDKALWPGRGPLETNVIDNFRDGAWRDTRGAYLVHMVDDNQVDLATALAISKGYVGRELEEQIRYLASHTVRLFSHNEGIADPQNRLTLSQTHKDVLGIPHPEVYYKLPEYTVKSCEHTRGMFRELIGLMHGTDEQWTPGYFPQDHPAGSTIMGTDPKDSVVDGFCRTHDHENLFMASSSVFSSVGTGNITLTVAALALRVADTLKKEL

What is claimed is:

1. A mutated Flavoprotein Glucose Dehydrogenase, subunit alpha (FAD-GDHα) protein, wherein the mutated FAD-GDHα protein comprises an amino acid sequence having at least 95% sequence identity to the amino acid sequence set forth in SEQ ID NO: 38 or SEQ ID NO: 39, and comprising at least two substitutions at the positions corresponding to residues 177, 215, 353 or 406 of the SEQ ID NO: 38 or SEQ ID NO: 39,
   wherein the amino acid at the position corresponding to residue 177 is S,
   wherein the amino acid at the position corresponding to residue 215 is selected from the group consisting of S, G, H, D and Y,
   wherein the amino acid at the position corresponding to residue 353 is L, and
   wherein the amino acid at the position corresponding to residue 406 is selected from the group consisting of L, S, C, T, M, V, Y, N, P, G, Q, A, I, D, H, and E.

2. The mutated FAD-GDHα protein of claim 1, wherein the amino acid sequence of the mutated FAD-GDHα protein comprises the amino acid sequence set forth in SEQ ID NO: 110 or SEQ ID NO: 111.

3. The mutated FAD-GDHα protein of claim 1, wherein the protein exhibits at least a 10% increase in glucose dehydrogenase activity compared to a non-mutated FAD-GDHα protein comprising the amino acid sequence of SEQ ID NO: 38 or SEQ ID NO: 39, wherein the protein exhibits at least a 10% increase in selectivity for glucose compared to a non-mutated FAD-GDHα protein comprising the amino acid sequence of SEQ ID NO: 38 or SEQ ID NO: 39 or wherein the protein exhibits at least a 10% increase in linearity of current as a function of glucose concentration compared to a non-mutated FAD-GDHα protein comprising the amino acid sequence of SEQ ID NO: 38 or SEQ ID NO: 39.

4. The mutated FAD-GDHα protein of claim 1, wherein the mutated FAD-GDHα protein comprises at least two substitutions, wherein the at least two substitutions are selected from the group consisting of N177S, N215S, F353L and F406L.

5. A Flavoprotein Glucose Dehydrogenase alpha subunit (FAD-GDHα) protein, wherein the amino acid sequence of the FAD-GDHα protein comprises the amino acid sequence set forth in SEQ ID NO: 38 or SEQ ID NO: 39 and comprises N177S, N215S, F353L and F406L substitutions.

6. A mutated Flavoprotein Glucose Dehydrogenase, subunit alpha (FAD-GDHα) protein, wherein the mutated FAD-GDHα protein comprises an amino acid sequence having at least 95% sequence identity to the amino acid sequence set forth in SEQ ID NO: 38 or SEQ ID NO: 39, and comprising a substitution at the position corresponding to residue 406 of the SEQ ID NO: 38 or SEQ ID NO: 39 and at least one substitution at the position corresponding to residues 177, 215 or 353 of the SEQ ID NO: 38 or SEQ ID NO: 39,
   wherein the amino acid the position corresponding to residue 406 is selected from the group consisting of L, S, C, T, M, V, Y, N, P, L, G, Q, A, I, D, H, and E,
   wherein the amino acid the position corresponding to residue 177 is S,
   wherein the amino acid the position corresponding to residue 215 is selected from the group consisting of S, G, H, D and Y, and
   wherein the amino acid the position corresponding to residue 353 is L.

7. An enzyme electrode, configured to measure the amount of glucose in a physiological fluid, comprising the mutated FAD-GDHα of claim 5 immobilized onto the electrode, wherein the mutated FAD-GDHα is configured to catalyze glucose in the physiological fluid and produce electrons that are transferred to the electrode thereby generating an electrical current, wherein the intensity of the electrical current is indicative of the level of glucose in the physiological fluid.

8. The enzyme electrode of claim 7, wherein the enzyme electrode is configured to perform a single measurement.

9. The enzyme electrode of claim 7, wherein the enzyme electrode is incorporated into a glucose test strip.

10. The enzyme electrode of claim 7, wherein the mutated FAD-GDHα is immobilized on the electrode in a conductive matrix or by chemical wiring.

11. The enzyme electrode of claim 10, wherein the conductive matrix is selected from a group consisting of carbon paste, graphite paste, and graphene oxide.

12. The enzyme electrode of claim 7, wherein the enzyme electrode, configured to measure the amount of glucose in a physiological fluid, comprising the mutated FAD-GDHα protein immobilized onto the electrode further comprises at least one subunit selected from the group consisting of: wild-type FAD-GDHβ subunit, and a wild-type FAD-GDHγ subunit.

13. The enzyme electrode of claim 7, wherein the enzyme electrode is incorporated into a biosensor configured for subcutaneous continuous glucose measurement, wherein the biosensor is configured to continually measure the amount of glucose in a subject.

14. The enzyme electrode of claim 13, wherein the biosensor comprises the mutated FAD-GDHα immobilized onto at least one enzyme electrode, wherein the mutated FAD-GDHα is configured to catalyze glucose in the subject and generate electrons that are transferred to the electrode and generate electrical current, wherein the intensity of the electrical current is indicative of the level of glucose in the subject.

15. The enzyme electrode of claim 14, wherein the enzyme electrode is configured to perform a continuous measurement for up to two weeks.

16. The enzyme electrode of claim 10, wherein the conductive matrix is a conductive polymer, and wherein the conductive polymer is selected from the group consisting of poly(3,4-ethylenedioxythiophene) and Polypyrrol.

* * * * *